US011998580B2

(12) United States Patent
Alvis et al.

(10) Patent No.: US 11,998,580 B2
(45) Date of Patent: Jun. 4, 2024

(54) GROUP B ADENOVIRUS-CONTAINING FORMULATION

(71) Applicant: AKAMIS BIO LIMITED, Oxfordshire (GB)

(72) Inventors: Simon Alvis, Oxfordshire (GB); Magdalena Kieltyka, Oxfordshire (GB)

(73) Assignee: AKAMIS BIO LIMITED, Oxfordshire (GB)

( * ) Notice: Subject to any disclaimer, the term of this patent is extended or adjusted under 35 U.S.C. 154(b) by 979 days.

(21) Appl. No.: 16/965,549

(22) PCT Filed: Jan. 31, 2019

(86) PCT No.: PCT/EP2019/052398
§ 371 (c)(1),
(2) Date: Jul. 28, 2020

(87) PCT Pub. No.: WO2019/149829
PCT Pub. Date: Aug. 8, 2019

(65) Prior Publication Data
US 2021/0121512 A1 Apr. 29, 2021

(30) Foreign Application Priority Data
Jan. 31, 2018 (GB) ..................... 1801614

(51) Int. Cl.
| *A61K 35/761* | (2015.01) |
| *A61K 9/00* | (2006.01) |
| *A61K 9/08* | (2006.01) |
| *A61K 47/10* | (2017.01) |
| *A61K 47/18* | (2017.01) |
| *A61K 47/20* | (2006.01) |
| *A61K 47/26* | (2006.01) |

(52) U.S. Cl.
CPC .......... *A61K 35/761* (2013.01); *A61K 9/0019* (2013.01); *A61K 9/08* (2013.01); *A61K 47/10* (2013.01); *A61K 47/183* (2013.01); *A61K 47/20* (2013.01); *A61K 47/26* (2013.01)

(58) Field of Classification Search
None
See application file for complete search history.

(56) References Cited

U.S. PATENT DOCUMENTS

| 5,595,756 | A | 1/1997 | Bally et al. |
| 7,235,391 | B2 | 6/2007 | Wu et al. |
| 7,264,958 | B1 | 9/2007 | Koehl et al. |
| 7,288,251 | B2 | 10/2007 | Bedian et al. |
| 2002/0061592 | A1 | 5/2002 | Blanche et al. |
| 2005/0186225 | A1* | 8/2005 | Evans ............... A61K 9/0019 424/233.1 |
| 2010/0297072 | A1 | 11/2010 | Depinho |
| 2011/0034560 | A1 | 2/2011 | Jacobson et al. |

FOREIGN PATENT DOCUMENTS

| CA | 2244213 | A1 | 8/1997 |
| CN | 101381742 | A | 3/2009 |
| CN | 1961961 | A | 5/2010 |
| EP | 170269 | A2 | 5/2007 |
| JP | 2000504334 | A | 4/2000 |
| JP | 2002541792 | A | 12/2002 |
| JP | 2008531700 | A | 8/2008 |
| JP | 2015526450 | A | 8/2015 |
| WO | 1999/018799 | A1 | 4/1999 |
| WO | 00/32754 | A1 | 6/2000 |
| WO | 2000061726 | A1 | 10/2000 |
| WO | 01/11034 | A2 | 2/2001 |
| WO | 2005/040220 | A1 | 5/2005 |
| WO | 2005/118825 | A2 | 12/2005 |
| WO | 2006093924 | A1 | 9/2008 |
| WO | 2013/026833 | A1 | 2/2013 |
| WO | 2013164754 | A2 | 11/2013 |
| WO | 2014029702 | A1 | 2/2014 |
| WO | 2015040234 | A1 | 3/2015 |
| WO | 2015/059303 | A1 | 4/2015 |
| WO | 2015/059465 | A1 | 4/2015 |
| WO | 2015153912 | A1 | 10/2015 |
| WO | 2016/030489 | A1 | 3/2016 |
| WO | 2016/174200 | A1 | 11/2016 |
| WO | 2016174200 | A1 | 11/2016 |

(Continued)

OTHER PUBLICATIONS

Nema S, Brendel RJ. Excipients and their role in approved injectable products: current usage and future directions. PDA J Pharm Sci Technol. May-Jun. 2011;65(3):287-332. doi: 10.5731/pdajpst.2011.00634. PMID: 22293237. (Year: 2011).*

Golovanov AP, Hautbergue GM, Wilson SA, Lian LY. A simple method for improving protein solubility and long-term stability. J Am Chem Soc. Jul. 28, 2004;126(29):8933-9. doi: 10.1021/ja049297h. PMID: 15264823. (Year: 2004).*

Chang, C-M, et al., Treatment of hepatocellular carcinoma with adeno-associated virus encoding interleukin-15 superagonist, Hum Gene Ther. May 2010;21(5):611-21.

Cheng, L., et al., Hyper-IL-15 suppresses metastatic and autochthonous liver cancer by promoting tumour-specific CD8+ T cell responses, J Hepatol. Dec. 2014;61(6):1297-303.

Guo, Y., et al., Immunobiology of the IL-15/IL-15Rα complex as an antitumor and antiviral agent, Cytokine Growth Factor Rev. Dec. 2017;38:10-21.

(Continued)

*Primary Examiner* — Benjamin P Blumel
*Assistant Examiner* — Jeffrey Mark Sifford
(74) *Attorney, Agent, or Firm* — Dechert LLP; Andrew T. Wilkins; Sean M. Coughlin

(57) ABSTRACT

The present disclosure provides a liquid formulation suitable for a group B adenovirus, comprising: a) a group B adenovirus, such as replication competent group B adenovirus, b) 15 to 25% v/v glycerol, for example 16, 17, 18, 19, 20, 21% v/v glycerol; and c) 0.1 to 1.5% v/v ethanol, for example 0.2-1%, such as 1% v/v ethanol; and d) a buffer, and e) optionally an amino acid, wherein the pH of the formulation is in the range 8.0 to 9.6, and use of the same in treatment, particular in the treatment of cancer.

17 Claims, 15 Drawing Sheets

Specification includes a Sequence Listing.

(56) References Cited

FOREIGN PATENT DOCUMENTS

| WO | WO-2016174200 A1 | * | 11/2016 | ........... A61K 35/761 |
|---|---|---|---|---|
| WO | 2017/161360 A2 | | 9/2017 | |
| WO | 2018/075978 A1 | | 4/2018 | |

OTHER PUBLICATIONS

Ni, S., et al., Evaluation of biodistribution and safety of adenovirus vectors containing group B fibers after intravenous injection into baboons, Hum Gene Ther. Jun. 2005;16(6):664-77.
International Search Report of PCT/EP2022/053477, dated Jun. 7, 2022.
Nemunaitis, J., et al., Intravenous infusion of a replication-selective adenovirus (ONYX-015) in cancer patients: safety, feasibility and biological activity, Gene Therapy (2001) 8, 746-759.
Riedmann, Human Vaccines: News, Human Vaccines & Immunotherapeutics (2012), 8(11):1550-1553.
Auerbach et al., Angiogenesis Assays; Problems and Pitfalls, Cancer and Metastasis Reviews (2000), 19:167-172.
Beans, Targeting Metastasis to Halt Cancer's Spread, PNAS (Dec. 11, 2018), 115 (50):12539-12543.
Gravanis et al., TPA as a Therapeutic Target in Stroke, Expert Opin Ther Targets (Feb. 2008), 12(2):1-18.
Gura, Systems for Identifying New Drugs Are Often Faulty, Science (Nov. 7, 1997), 278:1041-1042.
Hait, Anticancer Drug Development: the Grand Challenges, Nature Reviews Drug Discovery (Apr. 2010), 9:253-254.
Jain, Barriers to Drug Delivery in Solid Tumors, Scientific American (Jul. 1994), 58-65.
Sporn et al., Chemoprevention of Cancer, Carcinogenesis (2000), 21(3):525-530.
International Search Report and Written Opinion for PCT/EP2019/052398, dated Jun. 7, 2019.
Nakashima, E., et al., A candidate for cancer gene therapy: MIP-1 alpha gene transfer to an adenocarcinoma cell line reduced tumorigenicity and induced protective immunity in immunocompetent mice, Pharm Res. Dec. 1996;13 (12):1896-901.
Kaufman, H. L., et al., Oncolytic viruses: a new class of immunotherapy drugs, Nat Rev Drug Discov. Sep. 2015; 14 (9):642-62.
Ferrantini, M., et al., Interferon-alpha and cancer: mechanisms of action and new perspectives of clinical use, Biochimie. Jun.-Jul. 2007;89(6-7):884-93.
Plasmids 101: Multicistronic Vectors. Jan. 29, 2015, https://web.archive.org/web/20150129022727/https://blog.addgene.org/plasmids-101-multicistronic-vectors.

Gene Therapy Vaccinia Virus Vectors Explained. Feb. 1, 2015, https://web.archive.org/web/20150201083914/www.genetherapynet.com/viral-vector/vaccinia-viruses.html.
International Search Report and Written Opinion of PCT/EP2020/067668, dated Nov. 5, 2020.
Detergents: Triton X-100, Tween-20, and More, Jun. 10, 2020, Mater Methods 2013;3:163.
Clement, N., et al., Construction and production of oncotropic vectors, derived from MVM(p), that share reduced sequence homology with helper plasmids, Cancer Gene Ther. Sep. 2002;9(9):762-70.
Shashkova, E., et al., Characterization of human adenovirus serotypes 5, 6, 11, and 35 as anticancer agents, Virology Nov. 25, 2009;394(2):311-20.
Ferguson, M., et al., Systemic delivery of oncolytic viruses: hopes and hurdles, Advances in Virology, V 2012, Article ID 805629.
Carlisle, R.C., et al., Human erythrocytes bind and inactivate type 5 adenovirus by presenting Coxsackie virus-adenovirus receptor and complement receptor 1, Blood Feb. 26, 2009;113(9):1909-18.
Chau, L.A, et al., HuM291(Nuvion), a humanized Fc receptor-nonbinding antibody against CD3, anergizes peripheral blood T cells as partial agonist of the T cell receptor, Transplantation Apr. 15, 2001;71(7):941-50.
Diehl, K-H, et al., A good practice guide to the administration of substances and removal of blood, including routes and volumes. J. Appl. Toxicol, 21, 15-23 (2001).
Hemminki et al., AD3-HTERT-E1A, a Fully Serotype 3 Oncolytic Adenovirus, in Patients With Chemotherapy Refractory Cancer, Molecular Therapy (Aug. 7, 2012), 20(9):1810-1830.
Hotte et al., An Optimized Clinincal Regimen for the Oncolyticvirus PV701, Clinical Cancer Research (Feb. 1, 2007), 13(3):977-985.
Nemunaitis et al., Intravenous Infusion of a Replication-Selective Adenovirus (ONYX-015) in Cancer Patients: Safety, Feasibility and Biological Activity, Gene Therapy (2001), 8:746-759.
Small et al., A Phase I Trial of Intravenous CG7870, a Replication-Selective, Protate-Specific Antigen-Targeted Oncolytic Adenovirus, for the Treatment of Hormone-Refractory, Metastatic Prostate Cancer, Molecular Therapy (Jul. 2006), 14(1):107-117.
European Patent Office, Opposition Division, Decision Revocation of the European Patent No. EP 3007711, dated Feb. 21, 2023, Munich, Germany.
European Patent Office, Opposition Division, Consolidated List of Cited Opposition Documents, European Patent No. EP 3007711, dated Dec. 1, 2022, Munich, Germany.
Fisicaro et al., Versatile Co-Expression of Graft-Protective Proteins Using 2A-Linked Cassettes, Xenotransplantation (2011), 18(2):121-130.

* cited by examiner

Figure 1
A  Stored at 2-8°C
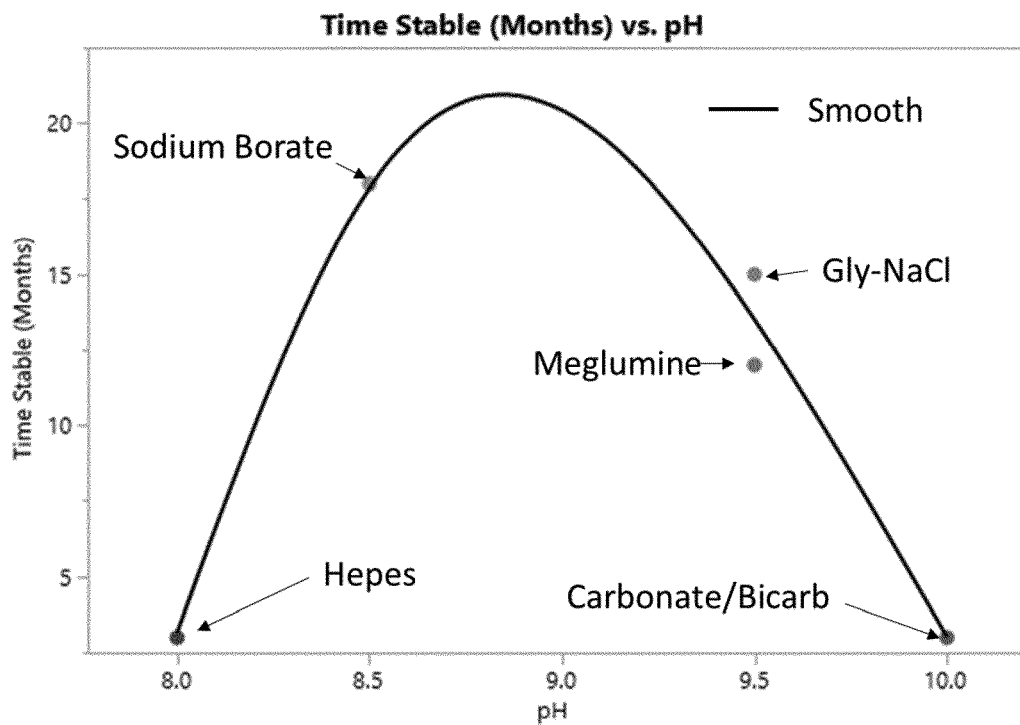
B  Accelerated Conditions 25°C
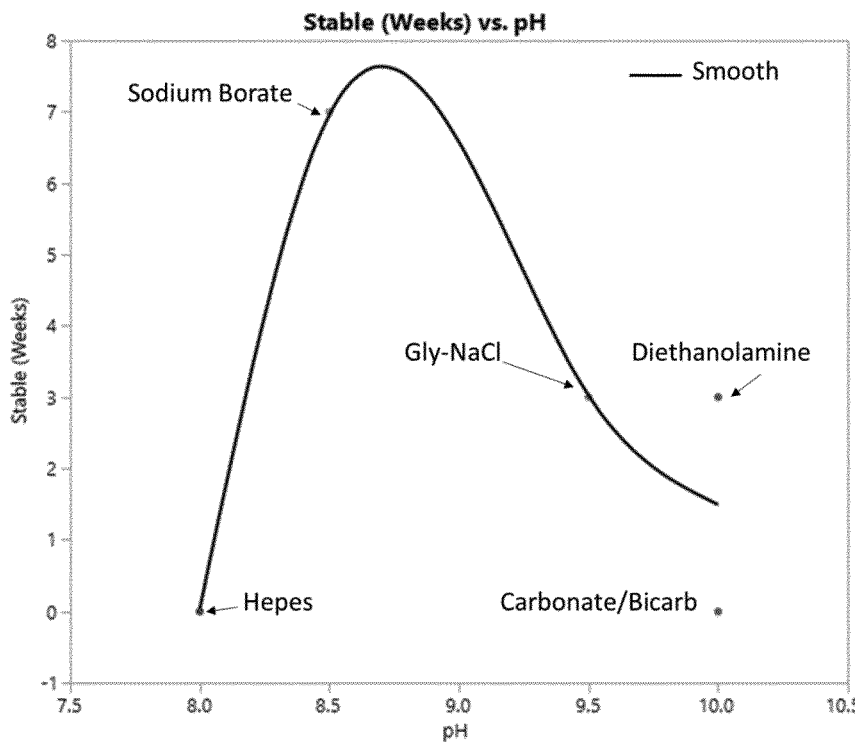

Figure 2 Accelerated Design of Experiments (DOE) Showing 15-20% Glycerol is Beneficial
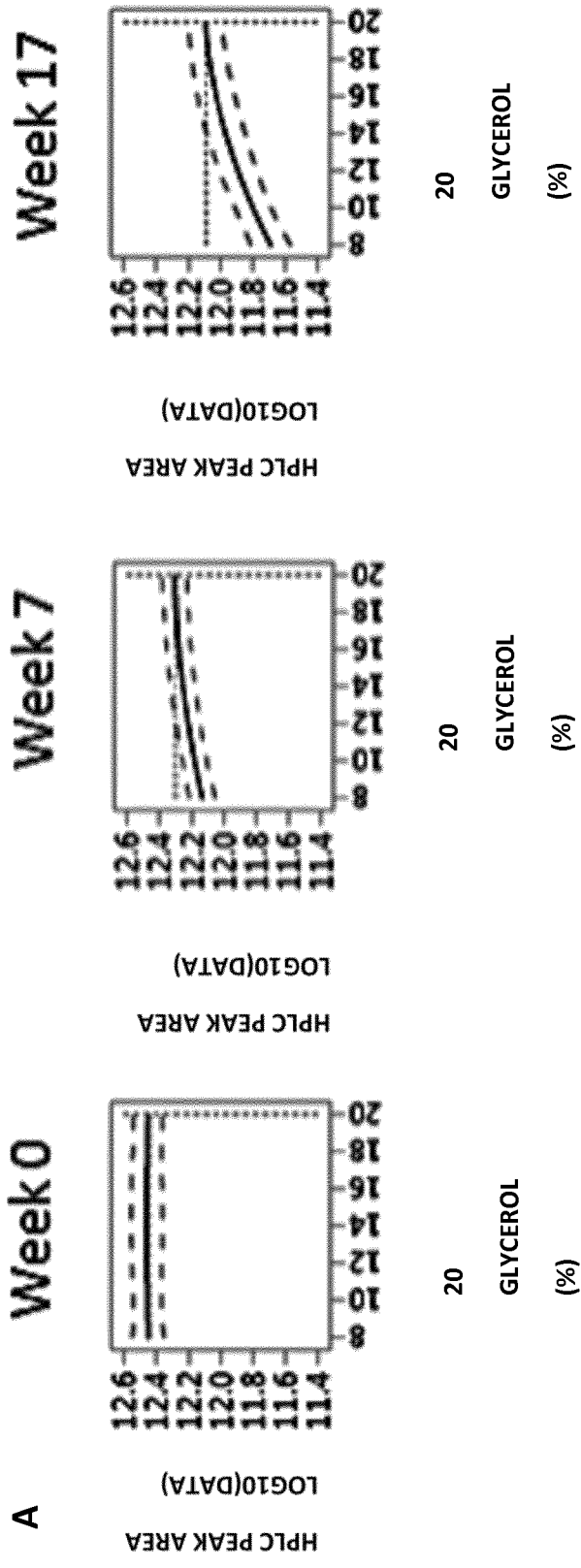

Figure 2 cont.
B    10Mm HEPES, with Glycerol/Accelerated Conditions
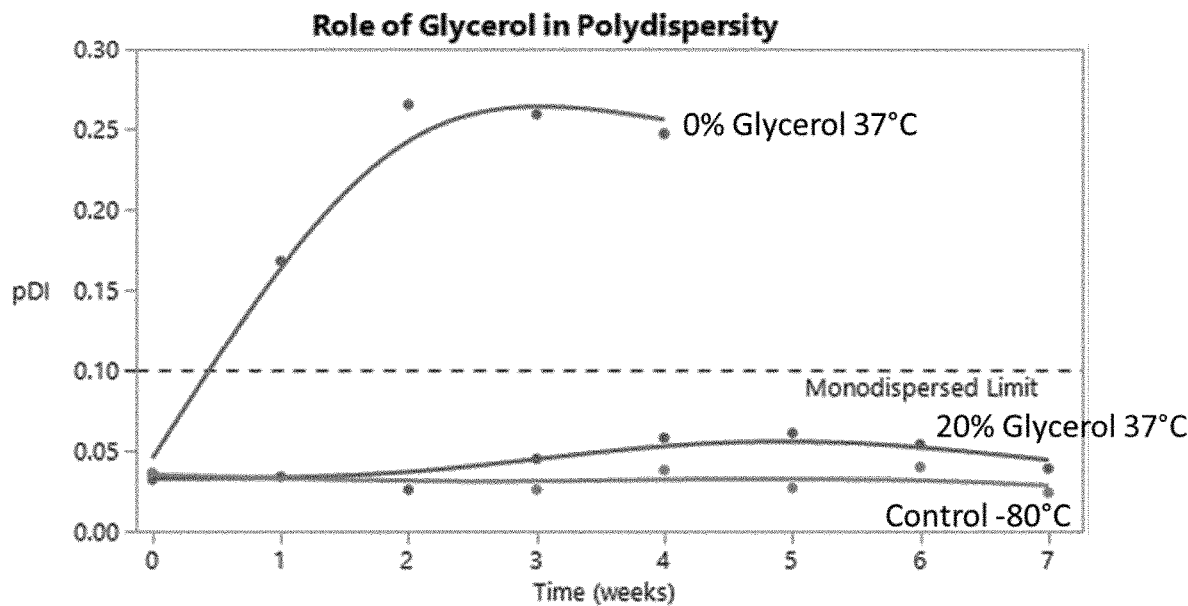
C    10Mm HEPES with Glycerol Stored at 25°C
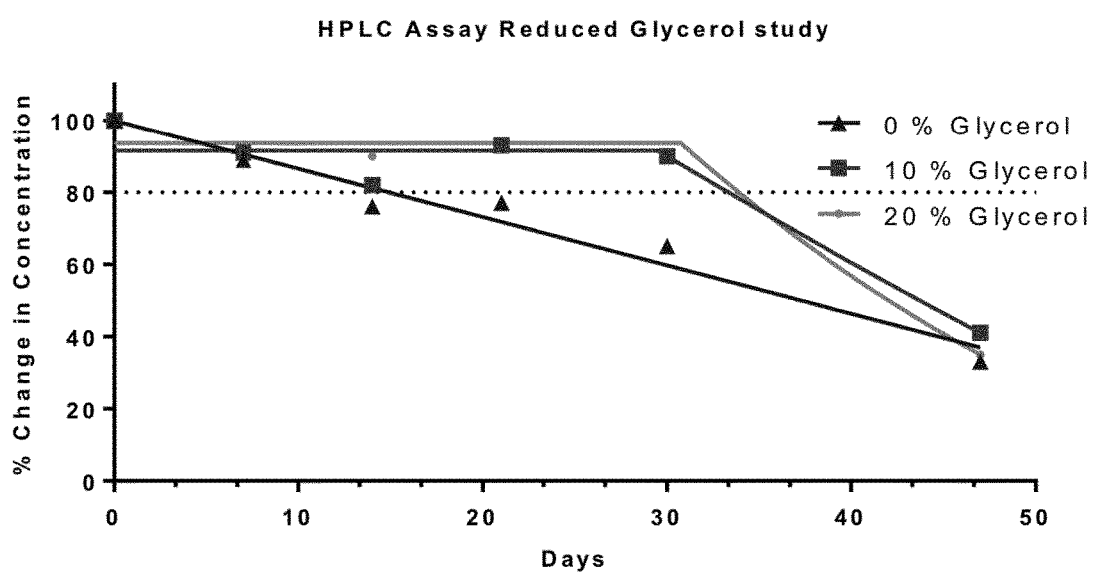

Figure 3
A  20% Glycerol and buffer at pH9 with HEPES control and stored at 4°C (no ethanol)
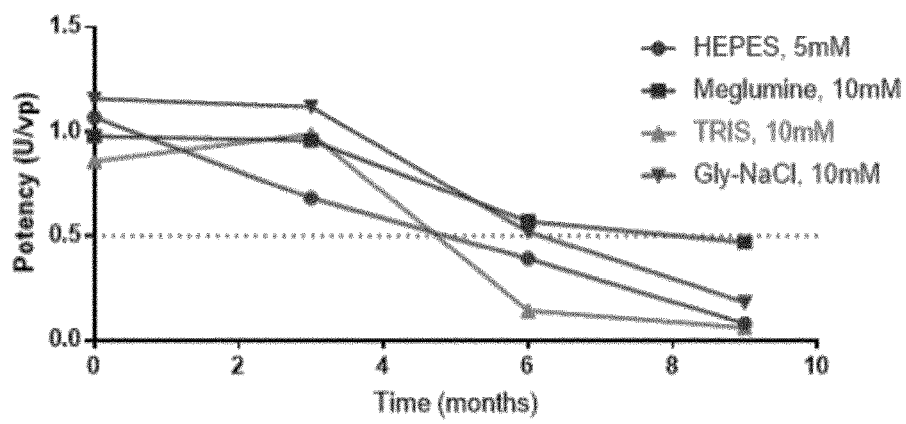
B  20% Glycerol and buffer at pH9 and 4°C (no ethanol)
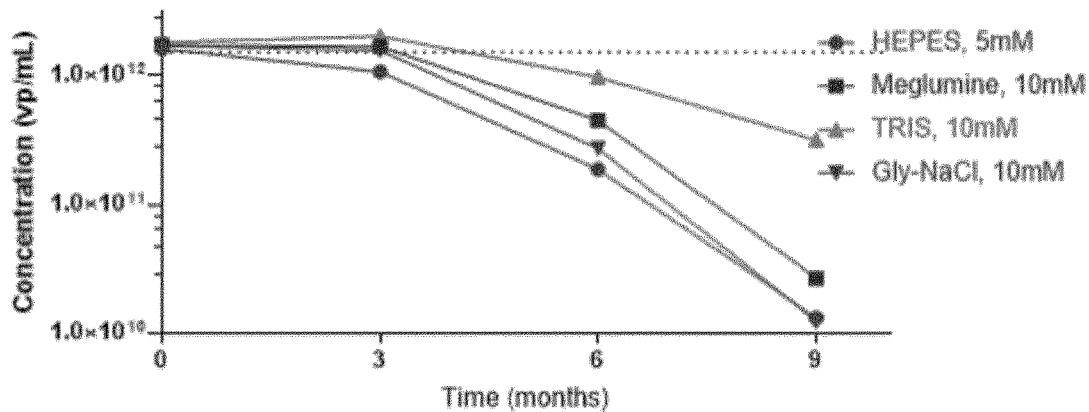
C  20% Glycerol, Meglumine or Gly-NaCl, Ethanol, Methionine, Polysobrate at pH9 and 4°C, HPLC analysis of conc. vp/ml
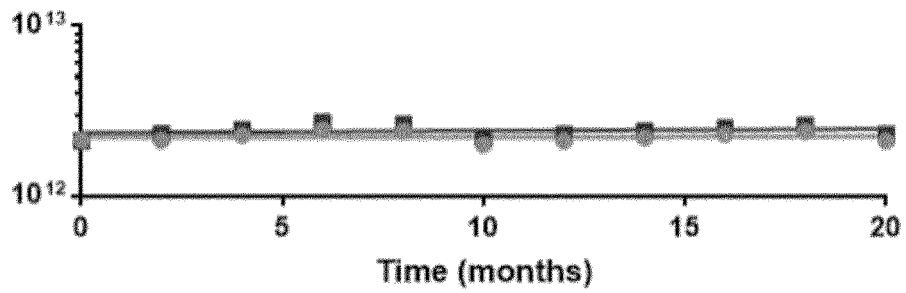

A Plus Polysorbate

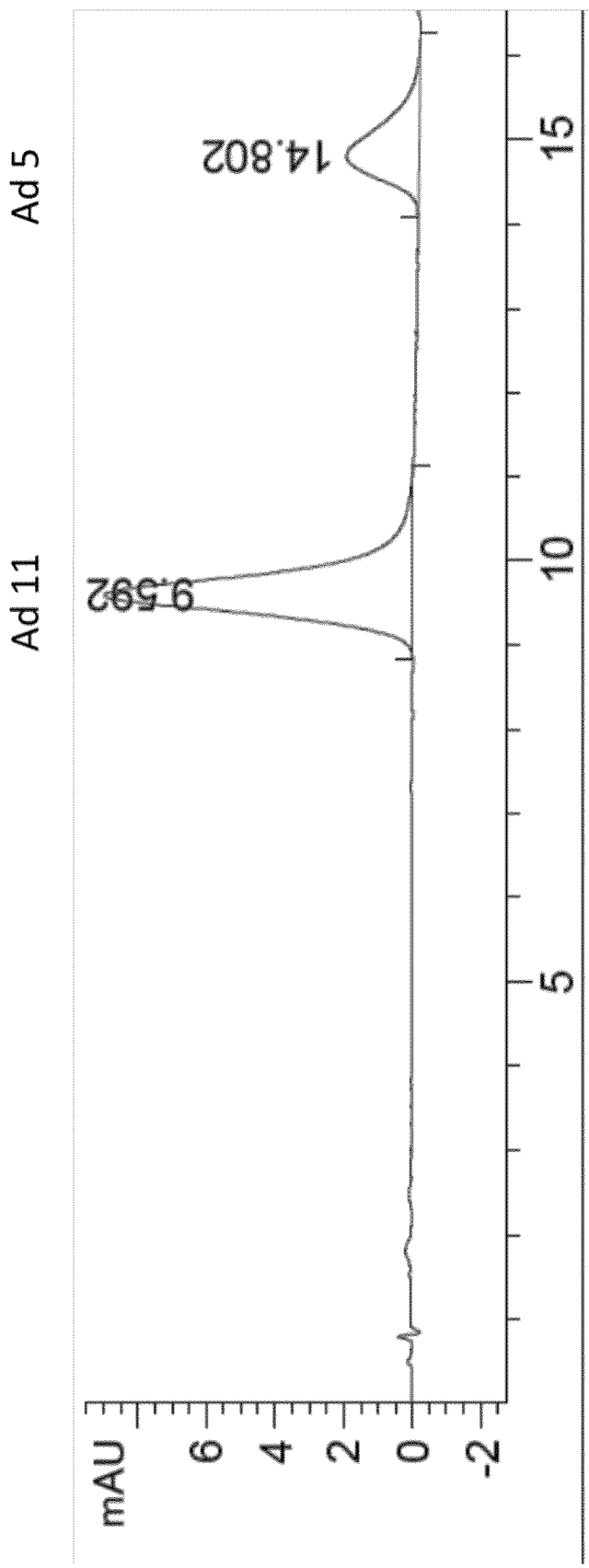
Figure 7    Analytical Separation of Adenovirus 5 (Ad 5) and Adenovirus 11 (Ad 11) by Anion Exchange Chromatography

Figure 8C Oncolytic Relative Potency Analysis (Buffering Agent, 20% glycerol, 1.4% ethanol, 15 mM arginine, 0.25 mM methionine)
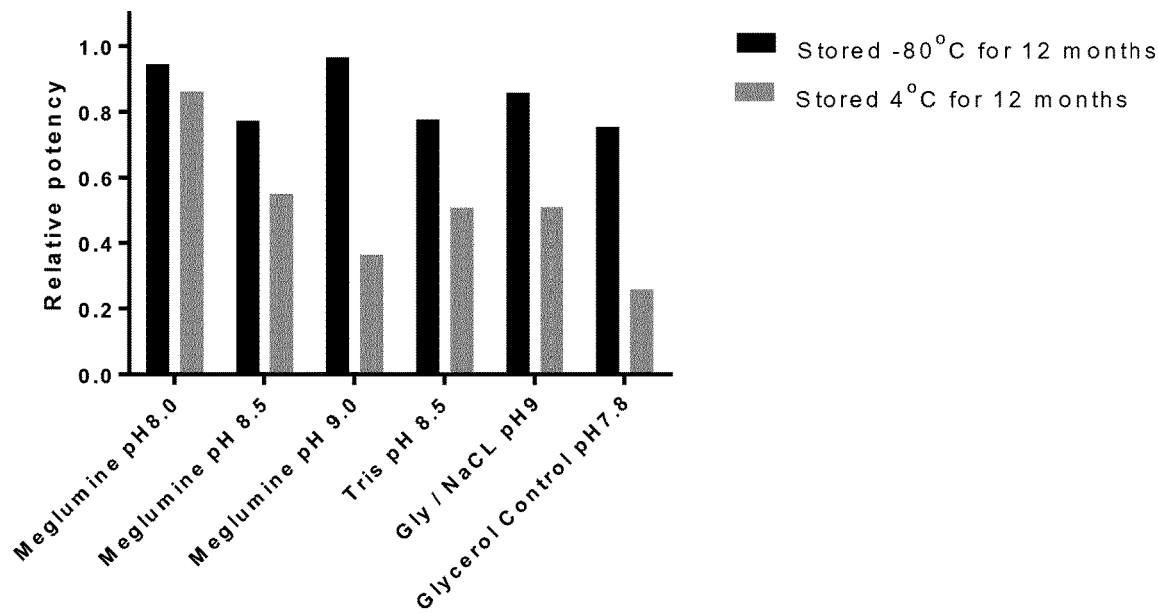
Figure 8D Virus Concentration by AEX-HPLC Analysis (Buffering Agent, 20% glycerol, 1.4% ethanol, 15 mM arginine, 0.25 mM methionine)
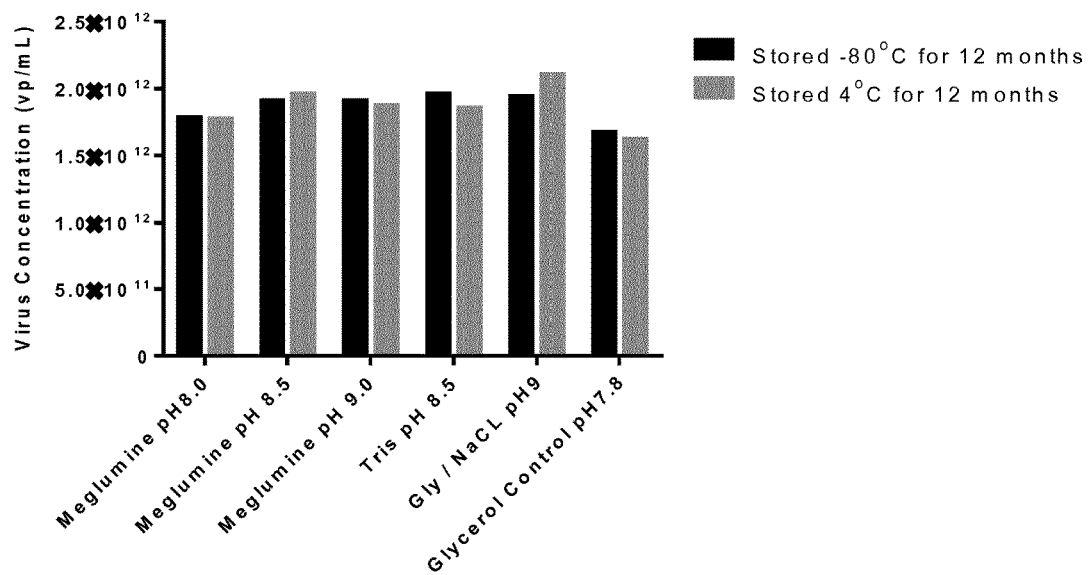

Ratio of total virus: infectious virus particles (Buffering Agent, 20% glycerol, 1.4% ethanol, 15 mM arginine, 0.25 mM methionine)

GROUP B ADENOVIRUS-CONTAINING FORMULATION

CROSS-REFERENCE TO RELATED APPLICATIONS

The present application is a 35 U.S.C. § 371 national phase application from International Application No. PCT/EP2019/052398, filed Jan. 31, 2019, and published under PCT Article 21(2) in English, which designated the U.S., and claims the benefit of priority from United Kingdom Patent Application No. GB1801614.7 filed on Jan. 31, 2018, and each of which prior applications are incorporated by reference herein into this application in their entirety including all tables, figures and claims.

SEQUENCE LISTING

The instant application contains a Sequence Listing which has been submitted in ASCII format via EFS-Web and is hereby incorporated by reference in its entirety. Said ASCII copy, created on Dec. 17, 2020, is named 314641-00045_Sequence_Listing.txt and is 2,382,527 bytes in size.

The present disclosure relates to a formulation of a group B adenovirus, such as enadenotucirev (EnAd), a process of making the formulation and use the formulation in treatment, in particular treatment of cancer.

BACKGROUND

At the present time the pharmaceutical field is on the edge of realising the potential of viruses as therapeutics for human use. To date a virus derived from dl1520, also referred to as ONYX-015 or CI-1042 and developed by ONYX Pharmaceuticals' and acquired by Shanghai Sunway Biotech, is approved for use in head and neck cancer in a limited number of countries and Imlygic® (Talimogene laherparepvec) has been approved for the treatment of melanoma. However, there are a number of viruses currently in the clinic, which should hopefully result in some of these being registered for use in humans.

A number of virus therapies are based on adenoviruses, such as Group B adenoviruses, for example EnAd. EnAd (previously known as ColoAd1) is a chimeric oncolytic adenovirus (WO2005/118825) currently in clinical trials for the treatment of epithelial cancer. These adenoviral based therapeutic agents need to be manufactured in quantities suitable for supporting both the clinical trials and demand after registration and under conditions that adhere to good manufacturing practice (GMP).

Adenoviral formulations for long term storage are known in the art, see for example US7,888,096 and US7,351,415. Such formulations have been used to suspend Group C adenoviruses such as Ad5, in particular replication deficient Ad5 viruses engineered to express human p53.

Group B adenoviruses have different properties to group C adenoviruses, for example the group B viruses infect cells via CD46, whereas group C viruses infect cell via the CAR receptor (coxsackievirus and adenovirus receptor). The group B viruses have a different retention time to group C viruses when analysed by high performance liquid chromatography. See for example FIG. 7, which shows the relative retention times of Ad5 and Ad11 type viruses (such as EnAd).

The present inventors have found that when prior art formulations are used to suspend Group B adenoviruses, such as EnAd, the adenoviruses can only be kept at 4° C. for very short periods of time before significant degradation in both virus concentration and potency occurs. This type of degradation is referred to as chemical degradation because it stems from chemical processes that occur in the formulation.

Physical stability is also very important, for example physical instability may manifest itself by aggregation, which may result in increased immunogenicity.

Accordingly, there is a need for an improved formulation specifically tailored for longer term storage of Group B adenoviruses, for example formulations suitable for storage at 4° C. This allows the formulations to be kept for longer periods at 4° C., with minimal detrimental effects on the potency and viability of the adenoviruses. This in turn makes the formulations considerably easier and cheaper to store and to transport, for example from a manufacturing facility to the clinic.

Surprisingly the present inventors have established that whilst a number of ingredients are important to the stabilisation of the group B virus formulation a small amount of ethanol seems to be essential to minimising degradation and maintaining infectivity.

The present disclosure provides a combination of ingredients, which together act to stabilise group B viruses, such as EnAd, in particular at 4° C.

SUMMARY OF THE INVENTION

The present disclosure provides formulations suitable for the storage of group B adenoviruses, for example a group B virus encoding at least one transgene, and is summarised in the following paragraphs:

1. A liquid formulation suitable for a group B adenovirus, comprising:
    a) a group B adenovirus, such as replication competent group B adenovirus,
    b) 15 to 25% v/v glycerol, (for example 17 to 20% v/v), such as 16, 17, 18, 19, 20, 21% v/v glycerol; and
    c) 0.1 to 1.6% v/v ethanol, for example 0.1-1.5%, such as 1% v/v ethanol or alternatively 1.4% or 1.5% v/v;
    d) a buffer,
    wherein the pH of the formulation is in the range 8.0 to 9.6, for example 8.0, 8.1, 8.2, 8.3, 8.4, 8.5, 8.6, 8.7, 8.8, 8.9, 9.0, 9.1, 9.2, 9.3, 9.4 or 9.5, such as 8.5 to 9.5, in particular 8.5 to 9.0, more specifically pH8.5, 8.6, 8.7, 8.8 or 8.9.
2. The formulation according to paragraph 1, wherein the pH is 8.0.
3. The formulation according to paragraph 1, wherein the pH is 8.1.
4. The formulation according to paragraph 1, wherein the pH is 8.2.
5. The formulation according to paragraph 1, wherein the pH is 8.3.
6. The formulation according to paragraph 1, wherein the pH is 8.4.
7. The formulation according to paragraph 1, wherein the pH is 8.5.
8. The formulation according to paragraph 1, wherein the pH is 8.6.
9. The formulation according to paragraph 1, wherein the pH is 8.7.
10. The formulation according to paragraph 1, wherein the pH is 8.8.
11. The formulation according to paragraph 1, wherein the pH is 8.9.
12. The formulation according to paragraph 1, wherein the pH is 9.

13. The formulation according to any one of paragraphs 1 to 12, wherein the formulation is for administration by intravenous administration, for example after dilution with a liquid for injection, such an isotonic solution or water for injection.
14. The formulation according to paragraph 13, wherein the formulation is for administration by slow injection.
15. The formulation according to paragraph 13, wherein the formulation is for administration by infusion.
16. The formulation according to any one of paragraphs 1 to 15 further comprising a surfactant, for example a nonionic surfactant.
17. The formulation according to paragraph 16, further comprising polysorbate, for example polysorbate 20, 40, 60, or 80, such as 0.05-0.15% v/v polysorbate 20, 40, 60, or 80.
18. The formulation according to paragraph 17, wherein the formulation comprises polysorbate 80, for example 0.05-0.15% v/v polysorbate 80, such as 0.115% v/v polysorbate 80.
19. The formulation according to any one of paragraphs 1 to 18, further comprising methionine, for example 0.01-0.3 mM, such as 0.01 to 0.25, in particular 0.25 mM methionine.
20. The formulation according to any one of paragraph 1 to 18, further comprising methionine, for example 0.01-0.3 mM, for example 0.01 to 0.2, such as 0.15 mM methionine.
21. The formulation according to any one of paragraphs 1 to 20, further comprising 5 to 20 mM, such as 15 mM arginine.
22. The formulation according to any one of paragraphs 1 to 20, further comprising arginine, for example 5 to 15 mM, such as 10 mM arginine.
23. The formulation according to any one of paragraphs 1 to 20, wherein the buffer is selected from meglumine, Gly-NaCl, and TRIS.
24. The formulation according to paragraph 23, wherein the formulation comprises meglumine buffer.
25. The formulation according to any one of paragraphs 1 to 24, wherein the formulation does not comprise HEPES buffer.
26. The formulation according to any one of paragraphs 1 to 15, wherein the formulation comprises:
    a) 15-20% v/v glycerol;
    b) 1-1.5% v/v ethanol;
    c) 0.2-0.3 mM methionine;
    d) 10-20 mM arginine; and
    e) a buffer, such as meglumine; and
    f) optionally 0.1-0.2% v/v polysorbate 80;
    wherein the pH of the formulation is at a pH in the range 8.0 to 9.5, for example 8.0 to 9.0, such as pH 8.0, 8.1, 8.2, 8.3, 8.4, 8.5, 8.6, 8.7, 8.8, 8.9 or 9.0, in particular 8.0
27. The formulation according to paragraph 26, wherein the formulation comprises
    a) 20% v/v glycerol;
    b) 1.4-1.5% v/v ethanol;
    c) 0.25 mM methionine;
    d) 15 mM arginine; and
    e) a buffer, such as meglumine;
    wherein the pH of the formulation is at a pH in the range 8.0 to 9.5, for example 8.0 to 9.0, such as pH 8.0, 8.1, 8.2, 8.3, 8.4, 8.5, 8.6, 8.7, 8.8, 8.9 or 9.0, in particular 8.0
28. The formulation according to any one of paragraphs 1 to 15, wherein the formulation comprises:
    a) 20% v/v glycerol;
    b) 1% v/v ethanol;
    c) 0.115% v/v polysorbate 80;
    d) 0.15 mM methionine;
    e) 10 mM arginine; and
    f) a buffer, such as meglumine;
    wherein the pH of the formulation is at a pH in the range 8.0 to 9.5, for example 8.5 to 9.5, such as pH 8.0, 8.1, 8.2, 8.3, 8.4, 8.5, 8.6, 8.7, 8.8, 8.9 or 9.0, in particular 9.0.
29. The formulation according to any one of the preceding paragraphs, wherein the group B adenovirus comprises a sequence of formula (I):

$$5'ITR-B_1-B_A-B_2-B_X-B_B-B_Y-B_3-3'ITR$$

wherein:
    $B_1$ is bond or comprises: E1A, E1B or E1A-E1B;
    $B_A$ comprises-E2B-L1-L2-L3-E2A-L4;
    $B_2$ is a bond or comprises: E3;
    $B_X$ is a bond or a DNA sequence comprising: a restriction site, one or more transgenes or both;
    $B_B$ comprises L5;
    $B_Y$ is a bond or a DNA sequence comprising: a restriction site, one or more transgenes or both;
    $B_3$ is a bond or comprises: E4;
    wherein at least one of $B_X$ or $B_Y$ is not a bond.
30. The formulation according to paragraph 29, wherein $B_X$ comprises a transgene or transgene cassette.
31. The formulation according to paragraphs 29 or 30, wherein $B_Y$ comprises a transgene or transgene cassette.
32. The formulation according to paragraph 29, wherein $B_Y$ comprises a transgene or transgene cassette and $B_X$ is a bond.
33. The formulation according to any one of paragraphs 29 to 32, wherein the one or more transgenes or transgene cassette is under the control of an endogenous or exogenous promoter, such as an endogenous promotor.
34. The formulation according to paragraph 33, wherein the transgene cassette is under the control of an endogenous promoter selected from the group consisting of E4 and major late promoter, in particular the major late promoter.
35. The formulation according to any one of paragraphs 29 to 34, wherein the transgene cassette further comprises a regulatory element independently selected from:
    a) a splice acceptor sequence (for example a short splice acceptor sequence CAGG, SEQ ID NO: 1 or SEQ ID NO: 2),
    b) an internal ribosome entry sequence or a high self-cleavage efficiency 2A peptide,
    c) a Kozak sequence, and
    d) combinations thereof
36. The formulation according to paragraph 35, wherein the transgene cassette comprises a Kozak sequence is at the start of the protein coding sequence.
37. The formulation according to any one of paragraphs 29 to 36, wherein the transgene cassette encodes a high self-cleavage efficiency 2A peptide, for example a P2A peptide, E2A peptide, F2A peptide and T2A peptide.
38. The formulation according to paragraph 37, wherein the transgene cassette encodes multiple high self-cleavage efficiency 2A peptides, such as 2, 3 or 4 peptides.

39. The formulation according to paragraph 38, wherein self-cleavage peptides are encoded by non-identical DNA sequences.
40. The formulation according to any one of paragraphs 29 to 39, wherein the transgene cassette further comprises a polyadenylation sequence.
41. The formulation according to any one of paragraphs 29 to 40, wherein the transgene cassette further comprises a sequence encoding a leader sequence.
42. The formulation according to any one of paragraphs 29 to 41, wherein the transgene cassette further comprises a restriction site at the 3'end of the DNA sequence and/or at the 5'end of the DNA sequence.
43. The formulation according to any of paragraphs 29 to 42, wherein at least one transgene cassette encodes monocistronic mRNA.
44. The formulation according to any one of paragraphs 29 to 43, wherein at least one transgene cassette encodes a polycistronic mRNA.
45. The formulation according to any one of paragraphs 29 to 44, wherein the transgene encodes an RNAi sequence, a polypeptide (such as protein or peptide).
46. The formulation according to paragraph 45, wherein the polypeptide is an antibody or binding fragment thereof
47. The formulation according to paragraph 46, wherein the antibody or binding fragment thereof is specific to 0X40, 0X40 ligand, CD27, CD28, CD30, CD40, CD40 ligand, CD70, CD137, GITR, 4-1BB, ICOS, ICOS ligand, CTLA-4, PD-1, PD-L1, PD-L2, VISTA, B7-H3, B7-H4, HVEM, ILT-2, ILT-3, ILT-4, TIM-3, LAG-3, BTLA, LIGHT, CD160, CTLA-4, PD-1, PD-L1, PD-L2, for example CD40 and CD40 ligand.
48. The formulation according to any one of paragraphs 45 to 47, wherein the encoded polypeptide is a cytokine independently selected from the group comprising IL-1α, IL-1β, IL-6, IL-9, IL-12, IL-13, IL-17, IL-18, IL-22, IL-23, IL-24, IL-25, IL-26, IL-27, IL-33, IL-35, IL-2, IL-4, IL-5, IL-7, IL-10, IL-15, IL-21, IL-25, IL-1RA, IFNα, IFNβ, IFNγ, TNFα, TGFβ, lymphotoxin α (LTA) and GM-CSF, for example IL-12, IL-18, IL-22, IL-7, IL-15, IL-21, IFNγ, TNFα, TGFβ and lymphotoxin α (LTA).
49. The formulation according to any one of paragraphs 24 to 44, wherein the encoded polypeptide is a independently selected from the group comprising IL-8, CCLS, CCL17, CCL20, CCL22, CXCL9, CXCL10, CXCL11, CXCL13, CXCL12, CCL2, CCL19, CCL21, CXCR2, CCR2, CCR4, CCR5, CCR6, CCR7, CCR8, CXCR3, CXCR4, CXCR5 and CRTH2, for example CCLS, CXCL9, CXCL12, CCL2, CCL19, CCL21, CXCR2, CCR2, CCR4 and CXCR4 or a receptor thereof (such as a chemokine selected from IL-8, CCLS, CCL17, CCL20, CCL22, CXCL9, CXCL10, CXCL11, CXCL13, CXCL12, CCL2, CCL19, CCL21 or a receptor thereof, more specifically CCLS, CXCL9, CXCL12, CCL2, CCL19, CCL21 or a receptor thereof).
50. The formulation according to any one of paragraphs 29 to 49, wherein the encoded polypeptide is a reporter gene, for example sodium iodide symporter, intracellular metalloproteins, HSV1-tk, GFPs, luciferase or estrogen receptor, for example sodium iodide symporter.
51. The formulation according to the paragraph 50, wherein the reporter gene is fluorescent protein.
52. The formulation according to any one of paragraphs 1 to 51, wherein the E4orf4 region of the adenovirus is non-functional, for example fully deleted, partially deleted or truncated.
53. The formulation according to any one of paragraphs 1 to 48, wherein the E2B region of the adenovirus is chimeric, for example wherein the E2B region comprises a nucleic acid sequence derived from a first adenoviral serotype and a nucleic acid sequence derived from a second distinct adenoviral serotype; wherein said first and second serotypes are each selected from the adenoviral subgroups B, C, D, E, or F.
54. The formulation according to any one of paragraphs 1 to 53, wherein the adenovirus is chimeric EnAd.
55. The formulation according to any one of paragraphs 1 to 54, wherein the adenovirus is Ad11.
56. The formulation according to any one of paragraphs 1 to 55, wherein the group B adenovirus is replication competent.
57. The formulation according to any one of paragraphs 1 to 56, wherein the virus is shown in SEQ ID NO: 14 or a derivative thereof, for example without a His-tag.
58. The formulation according to any one of paragraphs 1 to 57, wherein the virus is shown in SEQ ID NO: 15 or a derivative thereof, for example with or without a His-tag.
59. The formulation according to any one of paragraphs 1 to 58, wherein the virus is shown in SEQ ID NO: 16 or a derivative thereof, for example with or without a His-tag.
60. The formulation according to any one of paragraphs 1 to 59, wherein the virus is shown in SEQ ID NO: 17 or a derivative thereof, for example with or without a His-tag.
61. The formulation according to any one of paragraphs 1 to 60, wherein the virus is shown in SEQ ID NO: 18 or a derivative thereof, for example with or without a His-tag.
62. The formulation according to any one of paragraphs 1 to 61, wherein the virus is shown in SEQ ID NO: 19 or a derivative thereof, for example with or without a His-tag.
63. The formulation according to any one of paragraphs 1 to 62, wherein the virus is shown in SEQ ID NO: 20 or a derivative thereof, for example with or without a His-tag.
64. The formulation according to any one of paragraphs 1 to 63, wherein the virus is shown in SEQ ID NO: 21 or a derivative thereof, for example with or without a His-tag.
65. The formulation according to any one of paragraphs 1 to 64, wherein the virus is shown in SEQ ID NO: 22 or a derivative thereof, for example with or without a His-tag.
66. The formulation according to any one of paragraphs 1 to 65, wherein the virus is shown in SEQ ID NO: 23 or a derivative thereof, for example with or without a His-tag.
67. The formulation according to any one of paragraphs 1 to 66, wherein the virus is shown in SEQ ID NO: 24 or a derivative thereof, for example with or without a His-tag.
68. The formulation according to any one of paragraphs 1 to 67, wherein the virus is shown in SEQ ID NO: 25 or a derivative thereof, for example with or without a His-tag.

69. The formulation according to any one of paragraphs 1 to 68, wherein the virus is shown in SEQ ID NO: 26 or a derivative thereof, for example with or without a His-tag.
70. The formulation according to any one of paragraphs 1 to 69, wherein the virus is shown in SEQ ID NO: 27 or a derivative thereof, for example with or without a His-tag.
71. The formulation according to any one of paragraphs 1 to 70, wherein the virus is shown in SEQ ID NO: 28 or a derivative thereof, for example with or without a His-tag.
72. The formulation according to any one of paragraphs 1 to 71, wherein the virus is shown in SEQ ID NO: 29 or a derivative thereof, for example with or without a His-tag.
73. The formulation according to any one of paragraphs 1 to 72, wherein the virus is shown in SEQ ID NO: 30 or a derivative thereof, for example with or without a His-tag.
74. The formulation according to any one of paragraphs 1 to 73, wherein the virus is shown in SEQ ID NO: 31 or a derivative thereof, for example with or without a His-tag.
75. The formulation according to any one of paragraphs 1 to 74, wherein the virus is shown in SEQ ID NO: 32 or a derivative thereof, for example with or without a His-tag.
76. The formulation according to any one of paragraphs 1 to 75, wherein the virus is shown in SEQ ID NO: 33 or a derivative thereof, for example with or without a His-tag.
77. The formulation according to any one of paragraphs 1 to 76, wherein the virus is shown in SEQ ID NO: 34 or a derivative thereof, for example with or without a His-tag.
78. The formulation according to any one of paragraphs 1 to 77, wherein the virus is shown in SEQ ID NO: 35 or a derivative thereof, for example with or without a His-tag.
79. The formulation according to any one of paragraphs 1 to 78, wherein the virus is shown in SEQ ID NO: 36 or a derivative thereof, for example with or without a His-tag.
80. The formulation according to any one of paragraphs 1 to 79, wherein the virus is shown in SEQ ID NO: 37 or a derivative thereof, for example with or without a His-tag.
81. The formulation according to any one of paragraphs 1 to 80, wherein the virus is shown in SEQ ID NO: 38 or a derivative thereof, for example with or without a His-tag.
82. The formulation according to any one of paragraphs 1 to 81, wherein the virus is shown in SEQ ID NO: 39 or a derivative thereof, for example with or without a His-tag.
83. The formulation according to any one of paragraphs 1 to 82, wherein the virus is shown in SEQ ID NO: 40 or a derivative thereof, for example with or without a His-tag.
84. The formulation according to any one of paragraphs 1 to 83, wherein the virus is shown in SEQ ID NO: 41 or a derivative thereof, for example with or without a His-tag.
85. The formulation according to any one of paragraphs 1 to 84, wherein the virus is shown in SEQ ID NO: 42 or a derivative thereof, for example with or without a His-tag.
86. The formulation according to any one of paragraphs 1 to 85, wherein the virus is shown in SEQ ID NO: 43 or a derivative thereof, for example with or without a His-tag.
87. The formulation according to any one of paragraphs 1 to 86, wherein the virus is shown in SEQ ID NO: 44 or a derivative thereof, for example with or without a His-tag.
88. The formulation according to any one of paragraphs 1 to 87, wherein the virus is shown in SEQ ID NO: 45 or a derivative thereof, for example with or without a His-tag.
89. The formulation according to any one of paragraphs 1 to 88, wherein the virus is shown in SEQ ID NO: 46 or a derivative thereof, for example with or without a His-tag.
90. The formulation according to any one of paragraphs 1 to 89, wherein the virus is shown in SEQ ID NO: 47 or a derivative thereof, for example with or without a His-tag.
91. The formulation according to any one of paragraphs 1 to 86, wherein the virus is shown in SEQ ID NO: 48 or a derivative thereof, for example with or without a His-tag.
92. The formulation according to any one of paragraphs 1 to 91, wherein the virus is shown in SEQ ID NO: 49 or a derivative thereof, for example with or without a His-tag.
93. The formulation according to any one of paragraphs 1 to 92, wherein the virus is shown in SEQ ID NO: 50 or a derivative thereof, for example with or without a His-tag.
94. The formulation according to any one of paragraphs 1 to 93, wherein the virus is shown in SEQ ID NO: 51 or a derivative thereof, for example with or without a His-tag.
95. The formulation according to any one of paragraphs 1 to 94, wherein the virus is shown in SEQ ID NO: 52 or a derivative thereof, for example with or without a His-tag.
96. The formulation according to any one of paragraphs 1 to 95, wherein the virus is shown in SEQ ID NO: 53 or a derivative thereof, for example with or without a His-tag.
97. The formulation according to any one of paragraphs 1 to 96, wherein the virus is shown in SEQ ID NO: 54 or a derivative thereof, for example with or without a His-tag.
98. The formulation according to any one of paragraphs 1 to 97, wherein the virus is shown in SEQ ID NO: 55 or a derivative thereof, for example with or without a His-tag.
99. The formulation according to any one of paragraphs 1 to 98, wherein the virus is shown in SEQ ID NO: 56 or a derivative thereof, for example with or without a His-tag.
100. The formulation according to any one of paragraphs 1 to 99, wherein the virus is shown in SEQ ID NO: 57 or a derivative thereof, for example with or without a His-tag.

101. The formulation according to any one of paragraphs 1 to 100, wherein the virus is shown in SEQ ID NO: 58 or a derivative thereof, for example with or without a His-tag.
102. The formulation according to any one of paragraphs 1 to 101, wherein the virus is shown in SEQ ID NO: 59 or a derivative thereof, for example with or without a His-tag.
103. The formulation according to any one of paragraphs 1 to 102, wherein the virus is shown in SEQ ID NO: 60 or a derivative thereof, for example with or without a His-tag.
104. The formulation according to any one of paragraphs 1 to 103, wherein the virus is shown in SEQ ID NO: 61 or a derivative thereof, for example with or without a His-tag.
105. The formulation according to any one of paragraphs 1 to 104, wherein the virus is shown in SEQ ID NO: 62 or a derivative thereof, for example with or without a His-tag.
106. The formulation according to any one of paragraphs 1 to 105, wherein the virus is shown in SEQ ID NO: 63 or a derivative thereof, for example with or without a His-tag.
107. The formulation according to any one of paragraphs 1 to 106, wherein the virus is shown in SEQ ID NO: 64 or a derivative thereof, for example without a His-tag.
108. The formulation according to any one of paragraphs 1 to 107, wherein the virus is shown in SEQ ID NO: 65 or a derivative thereof, for example with or without a His-tag.
109. The formulation according to any one of paragraphs 1 to 108, for use in treatment.
110. The formulation according to paragraph 109, for use in the treatment of cancer, for example colorectal cancer, hepatoma, prostate cancer, pancreatic cancer, breast cancer, ovarian cancer, thyroid cancer, renal cancer, bladder cancer, head and neck cancer or lung cancer.
111. The formulation according to paragraph 109 or 110, for intravenous administration, for example after dilution with a liquid for injection.
112. The formulation according to paragraph 109 or 110, for intratumoral injection.
113. Use of a formulation according to any one of paragraphs 1 to 107 in the manufacture of a medicament for the treatment of cancer, for example colorectal cancer, hepatoma, prostate cancer, pancreatic cancer, breast cancer, ovarian cancer, thyroid cancer, renal cancer, bladder cancer, head and neck cancer or lung cancer.
114. A method of treatment, comprising administering a formulation according to any one of paragraphs 1 to 108 to a patient in need thereof
115. The method of treatment according to paragraph 114, wherein the patient to be treated has cancer, for example colorectal cancer, hepatoma, prostate cancer, pancreatic cancer, breast cancer, ovarian cancer, thyroid cancer, renal cancer, bladder cancer, head and neck cancer or lung cancer.
116. The method of paragraph 114 or 115, where the formulation is administered by intravenous or intratumoral injection.

Advantageously, the present inventors have established that the formulation as described herein allow group B adenoviruses, such as EnAd, to be successfully stored, for example at 4° C., for long periods of time such as 6 months or more, for example 1 year, 1.5 years and 2 years (in particular 18 to 24 months, such as 18, 19, 20, 21, 22, 23 or 24 months), without significant degradation or reduction in potency. Aggregation may also be minimised in the formulations of the present disclosure. Formulations of the disclosure may also be stable at temperatures such as 25° C. for moderate periods of time.

Long term storage of the virus may, for example be at temperatures such as −60° C. or lower, more specifically in the range −60 to −80° C., in particular −60, −61, −62, −63, −64, −65, −66, −67, −68, −69, −70, −71, −72, −73, −74, −75, −76, −77, −78, −79 and −80.

In one embodiment the formulations of the present disclosure have a pH of 8.5 to 9.5 (such as pH of 8.5, 8.6, 8.7, 8.8, 8.9, 9.0, 9.1, 9.2, 9.3, 9.4 or 9.5) which is significantly higher than physiological pH, i.e. pH 7.4.

In one embodiment, the formulation has a pH of 9.0. Surprisingly, the present inventors have discovered that the high pH has a significant effect on the stability of the group B adenoviruses (such as EnAd) in the formulation.

The concentration of glycerol is also important to the stability of the group B adenoviruses (such as EnAd).

According to the EU Medicines Agency, whilst ethanol is employed in oral and topical pharmaceutical formulations of small chemical entities and homeopathic remedies, there are certain safety concerns around the use of ethanol. Ethanol is a central nervous system depressant. Mild to moderate intoxication in adults can include euphoria, ataxia, sedation, aggressive behaviour, nausea and vomiting. At higher doses it can cause respiratory depression or failure, and cardiotoxicities, such as atrial tachycardia, atrial fibrillation, arrhythmias, AV block, hypotension, congestive heart failure and severe myocardial depression. In children ethanol intoxication can result in hypoglycaemia, hypothermia and comma. Other toxicities after acute exposure include seizures, hypotonia, hyporeflexia, gastrointestinal bleeding, acute hepatitis, acute pancreatitis, rhabdomyolysis, hypokalaemia, and lactic acidosis.

Ethanol metabolism varies between individuals and with age, for example some individuals are deficient in the enzyme alcohol dehydrogenase, which reduces their ability to metabolize alcohol. In formulations for intravenous administration the ethanol goes straight into the blood stream, which maximises any toxic effects. In addition, the volumes administered can be large so 500 ml to 1 L of formulation containing 10% of ethanol is 50 to 100 ml of ethanol.

Thus, whilst the ethanol seems to be an important to the stabilising of group B adenovirus formulations it is important that the toxicity of the ethanol is the formulation be minimised. Surprisingly very small amounts of ethanol, for example less than 1.5%, such as less than 1% are sufficient to provide the stabilisation. In one embodiment not more than 1.5% of ethanol is employed, for example not more than 1% is employed. This is beneficial because it minimises the toxicity of the ethanol whilst providing stabilising effects. In addition, it renders the formulations suitable for use in most patient populations.

In one embodiment the formulation of the present disclosure comprises a non-ionic surfactant, for example selected from the group comprising Cetomacrogol™_1000 (also known as Brij® 52, 56 or 58), cetostearyl alcohol, palmitic acid, glycerol monolaurate, oleyl alcohol, poloxamers, Pluronic™_F127 (poloxamer 407), polysorbates (for example polysorbate 20, 40, 60, 80 or 85), stearic acid, sorbitan tristearate. In one embodiment a nonionic surfactant with a hydrophile-lipophile balance in the range 14.5 to 17 is employed.

In one embodiment, the formulation further comprising polysorbate, for example polysorbate 20, 40, 60, or 80, such as 0.05-0.15% polysorbate 20, 40, 60, 80 or a combination of two or more of the same. In one embodiment, the formulation comprises 0.05%, 0.06%, 0.07%, 0.08%, 0.09%, 0.10%, 0.11%, 0.12%, 0.13%, 0.14%, or 0.15% polysorbate 20, 40, 60 80, or a combination of two or more of the same. The advantage of adding polysorbate to the formulation is that polysorbate helps to preserve group B adenovirus potency during long term storage and may minimise aggregation.

In one embodiment, the formulation comprises polysorbate 80, for example 0.05-0.15% polysorbate 80, such as 0.09 to 0.11% polysorbate 80, such as 0.1% or 0.115% polysorbate. In one embodiment, the formulation comprises 0.115% polysorbate.

Advantageously, the non-ionic surfactant, in particular polysorbate (such as polysorbate 80) reduces or inhibits interfacial stress within the formulation, for example reduces surface stress on the virus, which in turn can cause disruption of the virus.

Whilst not wishing to be bound by theory it is thought that the addition of certain amino acids, for example methionine, arginine and combinations thereof to the formulation may reduce virus/virus interaction and thereby contribute to stabilising the distribution of group B adenovirus in the formulation, for example by providing steric protection. The addition of the amino acid(s), for example methionine, arginine and combinations thereof may also optimise the preferential hydration/exclusion of the group B adenovirus. This parameter is thought to be of major importance in stabilising the group B adenovirus. Preferential interactions can be expressed in terms of preferential binding of the co-solvent (such as water) or its preferential exclusion (preferential hydration).

In one embodiment the formulation further comprises at least one amino acid, for example 1, 2, or 3 amino acids.

In one embodiment the at least one amino acid has a hydrophobic side chain, for example is selected from alanine, isoleucine, leucine, methionine, valine and combinations thereof.

In one embodiment the formulation further comprises methionine, for example 0.01-0.3 mM (0.01-0.2 mM), for example 0.01, 0.02, 0.03, 0.04, 0.05, 0.06, 0.07, 0.08, 0.09, 0.10, 0.12, 0.13, 0.14, 0.15, 0.16, 0.17, 0.18, 0.19, 0.20 mM such as 0.15 mM methionine. Alternatively, the methionine may be present at 0.25 mM in the formulation.

In one embodiment the formulation the at least one amino acid has a basic electronically charged side chain, for example is selected from arginine, histidine, lysine and combinations thereof.

In one embodiment, the formulation further comprises arginine, for example 1 to 20 mM (or 1 to 15 mM), for example 2 to 10 mM of arginine, such as 2, 2.5, 3, 3.5, 4, 4.5, 5, 5.5, 6, 6.5, 7, 7.5, 8, 8.5, 9, 9.5, or 10 mM arginine. In one embodiment the arginine in the formulation is in the range 10 to 20 mM, for example 10, 11, 12, 13, 14, 15, 16, 17, 18, 19 or 20 mM, such as 14, 15 or 16 mM. Advantageously, the addition of arginine to the formulation further enhances the stability of the adenoviruses, particularly during the first 12 months of storage.

In one embodiment, the formulation further comprises one or more of the following: meglumine buffer, Glycine buffer, TRIS buffer. These buffers were all shown to produce good stability when incorporated into the disclosed formulation.

In one embodiment, the formulation comprises meglumine buffer, for example at pH 8.0. Meglumine buffer is suitable for use in the pH range 8.0 to 10.5 such as 8.5 to 10.5.

In one embodiment the buffer is TRIS. TRIS is able to buffer in the range pH 7 to 9. In one embodiment the buffer does not comprise TRIS.

In one embodiment the buffer is glycine buffer, which is able to buffer in the range pH 8.6 to 10.6

The buffer must to be selected to match the pH, for example HEPES is only able to buffer up to pH 8.2. Other buffers disclosed herein may provide improved stability profiles for group B adenoviruses compared to HEPES. Thus, although HEPEs is commonly used for the storage of Group B adenoviruses such as EnAd, in one embodiment, the formulation does not comprise HEPES buffer.

In one embodiment the virus in the formulation according to the present disclosure encodes, 1, 2, 3 or 4 transgenes.

Definitions for Formula (I)

In one embodiment $B_X$ comprises a restriction site, for example 1, 2, 3 or 4 restriction sites, such as 1 or 2. In one embodiment $B_X$ comprises at least one transgene, for example 1 or 2 transgenes. In one embodiment $B_X$ comprises at least one transgene, for example 1 or 2 transgenes and one or more restriction sites, for example 2 or 3 restriction sites, in particular where the restriction sites sandwich a gene or the DNA sequence comprising the genes to allow it/them to be specifically excised from the genome and/or replaced. Alternatively, the restriction sites may sandwich each gene, for example when there are two transgenes three different restriction sites are required to ensure that the genes can be selectively excised and/or replaced. In one embodiment one or more, for example all the transgenes are in the form a transgene cassette.

In one embodiment $B_X$ does not comprise a restriction site. In one embodiment $B_X$ is a bond. In one embodiment $B_X$ comprises or consists of one or more transgenes.

In one embodiment $B_Y$ comprises a restriction site, for example 1, 2, 3 or 4 restriction sites, such as 1 or 2. In one embodiment $B_Y$ comprises at least one transgene, for example 1 or 2 transgenes. In one embodiment $B_Y$ comprises at least one transgene, for example 1 or 2 transgenes and one or more restriction sites, for example 2 or 3 restriction sites, in particular where the restriction sites sandwich a gene or the DNA sequence comprising the genes to allow it/them to be specifically excised from the genome and/or replaced. Alternatively, the restriction sites may sandwich each gene, for example when there are two transgenes three different restriction sites are required to ensure that the genes can be selectively excised and/or replaced.

In one embodiment $B_Y$ does not comprise a restriction site. In one embodiment $B_Y$ is a bond. In one embodiment $B_Y$ comprises or consists of one or more transgenes.

In addition to minimising the size of the transgene cassette, employing an endogenous promoter in the virus may also be advantageous in a therapeutic context because the transgene is only expressed when the virus is replicating. This is in contrast to a constitutive exogenous promoter which will continually transcribe the transgene and may lead to an inappropriate concentration or localization of the encoded entity, such as the encoded polypeptide.

Alternatively, employing an exogenous promoter may be advantageous because it can strongly and constitutively express the encoded entity, which may be particularly useful in some situations, for example where the patient has very pervasive cancer. Hence, in one embodiment expression of the transgene is under the control of a CMV promoter.

In one embodiment, the transgene cassette further comprises a regulatory element independently selected from: a splice acceptor sequence, an internal ribosome entry sequence or a high self-cleavage efficiency 2A peptide, a Kozak sequence, and combinations thereof.

In one embodiment, the transgene cassette comprises a Kozak sequence is at the start of the protein coding sequence.

In one embodiment, the transgene cassette encodes a high self-cleavage efficiency 2A peptide.

In one embodiment, the transgene cassette further comprises a polyadenylation sequence.

In one embodiment, the transgene cassette further comprises a restriction site at the 3'end of the DNA sequence and/or at the 5'end of the DNA sequence.

DETAILED DESCRIPTION OF THE DISCLOSURE

The presently disclosed formulation has a alkaline pH, which is above physiological pH. The buffering of a given solution to a specific pH can be performed using routine techniques know in the art, for example including to an acid/base system comprising Tris, lysine, a strong acid (e.g. HCl) or a weak acid (e.g. acetic acid or maleic acid, a strong base (e.g. NaOH) or weak base (e.g. ammonia).

As used herein, buffer refers to a buffer suitable for suspending or storing group B adenoviruses, without negatively affecting the structural integrity of said group B adenoviruses or their ability to replicate for example. Most biological buffers in use today were developed by NE Good and his research team (Good et al. 1966, Good & Izawa 1972, Ferguson et al. 1980; "Good buffers") and include N-substituted taurine or glycine buffers. Some commonly used biological buffers are listed below. This list is not exhaustive and other buffers will also be known to the skilled addressee.

In one embodiment, the disclosed formulation comprises one or more of the following buffers: 2-aminoethanesulfonic acid (AES) buffer, formate buffer (such as ammonium formate buffer, ammonium acetate buffer), 2-amino-2-methyl-1-propanol (AMP) buffer, 2-amino-2-methyl-1-propanediol (AMP D) buffer, N-(1,1,-Dimethyl-2-hydroxyethyl)-3-amino-2-hydroxypropane sulfonic acid (AMPS 0) buffer, bicine buffer, bis-tris-propane, boric acid buffer, 3-(cyclohexylamino)-2-hydroxy-1-propanesulfonic acid (CAPSO) buffer, N-Cyclohexyl-2-aminoethanesulfonic acid (CHES) buffer, 3-[4-(2-Hydroxyethyl)-1-piperazinyl]propanesulfonic acid (HEPPS) buffer, 1-methylpiperidine buffer, 4-(2-Hydroxyethyl)piperazine-1-(2-hydroxypropanesulfonic acid) (HEPPS 0) buffer, glycylglycine buffer, piperazine-1,4-bis(2-hydroxypropanesulfonic acid) dihydrate or Piperazine-N,N'-bis(2-hydroxypropanesulfonic acid) (POPSO) buffer, [tris(hydroxymethyl)methylamino] propanesulfonic acid (TAPS) buffer, 3-[N-tris(hydroxylmethyl)-methylamino]-2-hydroxypropanesulfonic acid (TAPS 0) buffer, triethanolamine buffer, 2-[tris(hydroxymethyl)-methylamino]-ethanesulfonic acid (TES) buffer, tricine buffer, meglumine buffer, glycine buffer (such as Gly-NaOH), TRIS buffer.

In one embodiment, the disclosed formulation comprises one or more of the following buffers: meglumine buffer, Gly-NaCl buffer, TRIS buffer.

Long term as used herein refers to a period of at least 6 months, such as 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or 36 months. In one embodiment, the disclosed formulation allows group B adenoviruses to be stably stored for at least 12 months, such as 12 months, 18 months and 24 months. Unless specified, long term storage generally refers to storage at 4° C.

In one embodiment the formulation is stored at a temperature in the range −1 to −95° C., for example −1 to −80° C., such as −1, −2, −3, −4, or −65, −66, −67, −68, −69, −70, −71, −72, −73, −74, −75, −77, −78, −79, −80, −81, −82, −83, −84, −85, −86, −87, −88, −89 or −90° C., in particular −80° C.

In one embodiment there is provided a liquid parenteral formulation (including a reconstituted formulation), for example for infusion or injection, for example of a replication capable oncolytic according to the present disclosure wherein the formulation provides a dose in the range of $1 \times 10^{10}$ to $1 \times 10^{14}$ viral particles per volume of dose.

In one embodiment the liquid formulations is provided as a concentrate, which requires dilution before administration to a patient.

In one embodiment the formulation is provided as a lyophilised formulation for reconstitution with an injectable liquid, such as water for injection, saline or glucose.

In one embodiment the formulation is provided as a liquid concentration, for dilution with liquid for injection, such as water for injection, saline, glucose or similar.

In one embodiment the formulation is manufactured as a liquid (is not lyophilised at any time), in particular in a final form, i.e. suitable for administration to a patient.

Parenteral formulation means a formulation designed not to be delivered through the GI tract. Typical parenteral delivery routes include injection, implantation or infusion. In one embodiment the formulation is provided in a form for bolus delivery.

In one embodiment the parenteral formulation is in the form of an injection. Injection includes intravenous, subcutaneous, intra-tumoral or intramuscular injection. Injection as employed herein means the insertion of liquid into the body via a syringe. In one embodiment the method of the present disclosure does not involve intra-tumoral injection.

In one embodiment the parenteral formulation is in the form of an infusion.

Infusion as employed herein means the administration of fluids by drip, infusion pump, syringe driver or equivalent device. In one embodiment the infusion is administered over a period in the range of 1.5 minutes to 120 minutes, such as about 3, 4, 5, 6, 7, 8, 9, 10, 11, 12, 13, 14, 15, 16, 17, 18, 19 20, 25, 30, 35, 40, 45, 50, 55, 60, 65, 70, 65, 80, 85, 90, 95, 100, 105, 110 or 115 minutes.

In one embodiment one dose of the formulation less than 100 mls, for example 30 mls, such as administered by a syringe driver.

In one embodiment the injection is administered as a slow injection, for example over a period of 1.5 to 30 minutes. Slow injection as employed herein is manual injection with syringe.

In one embodiment the formulation is for intravenous (i.v.) administration. This route is particularly effective for delivery of oncolytic virus because it allows rapid access to the majority of the organs and tissue and is particular useful for the treatment of metastases, for example established metastases especially those located in highly vascularized regions such as the liver and lungs.

Therapeutic formulations typically will be sterile and stable under the conditions of manufacture and storage. The composition can be formulated as a solution, microemulsion, liposome, or other parenteral formulation suitable for administration to a human.

Formulations according to the present disclosure may be formulated as a pre-filled device such as a syringe or vial, particular as a single dose.

The formulation will generally comprise a pharmaceutically acceptable diluent or carrier, for example a non-toxic, isotonic carrier that is compatible with the virus, and in which the virus is stable for the requisite period of time.

The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a dispersant or surfactant such as lecithin or a non-ionic surfactant such as polysorbate 80 or 40. In dispersions the maintenance of the required particle size may be assisted by the presence of a surfactant. Examples of isotonic agents include sugars, polyalcohols such as mannitol, sorbitol, or sodium chloride in the composition.

In one embodiment parenteral formulations employed may comprise a sugar for example dextrose, mannose, sucrose or similar, a salt such as sodium chloride, magnesium chloride or potassium chloride and a combination of two or more the same.

In one embodiment the formulation according to the present disclosure does not comprise a sugar. Components of the buffer are not considered sugars, for the purpose of this disclosure.

In one embodiment the formulation of the present disclosure does not comprise a salt, such as sodium chloride. Reagents employed in the buffer are not considered salt for the purposes of the present disclosure.

In one embodiment the formulation of the present disclosure does not comprise a divalent cation, for example $CaCl_2$, and/or $MgCl_2$.

The formulation may also comprise a preservative such as EDTA. In one embodiment the formulation of the present disclosure does not contain EDTA.

In one embodiment the formulation according to the present disclosure does not comprise chlorobutanol.

In one embodiment the formulation of the disclosure does not comprise gelatin.

In one embodiment the formulations don't contain any ingredients which increase the immunogenicity of the group B adenovirus i.e. the formulations don't contain adjuvant(s).

In one embodiment the formulation will comprise purified oncolytic virus according to the present disclosure, for example $1\times10^{18}$ to $1\times10^{14}$ viral particles per dose, such as $1\times10^{18}$ to $1\times10^{12}$ viral particles per dose. In one embodiment the concentration of virus in the formulation is in the range $2\times10^{8}$ to $2\times10^{11}$ vp/ml, such as $2\times10^{12}$ vp/ml.

A thorough discussion of pharmaceutically acceptable carriers is available in Remington's Pharmaceutical Sciences (Mack Publishing Company, N.J. 1991).

The present disclosure also extends to liquid solutions or suspensions delivered intra-nasally, for example employing a device as disclosed in WO2009/068877 and US2004/0153033 both incorporated herein by reference.

Group B Adenovirus as employed will generally refer to a replication capable (including replication competent) adenovirus or replication deficient virus designated as a group B virus, for example Ad11, such as Ad11p including chimaeras thereof, such as EnAd, unless the context indicates otherwise. In some instances, it may be employed to refer only to replication competent viruses and this will be clear from the context.

Subgroup B (group B or type B) as employed herein refers to viruses with at least the fibre and hexon from a group B adenovirus, for example the whole capsid from a group B virus, such as substantially the whole genome from a group B virus. Subgroup B viruses include 3, 7, 11, 14, 16, 21, 34, 35, 50 and 55.

In one embodiment the virus of the disclosure, such as an oncolytic virus has an Ad11 hexon, such as an A11p hexon.

In one embodiment the virus of the disclosure, such as an oncolytic virus has a subgroup B fibre. In one the virus of the disclosure, such as an oncolytic virus has an Ad11 fibre, such as an A11p fibre. In one embodiment the virus of the disclosure, such as an oncolytic virus has fibre and hexon proteins from the same serotype, for example a subgroup B adenovirus, such as Ad11, in particular Ad11p.

In one embodiment the virus of the disclosure, such as an oncolytic virus has fibre, hexon and penton proteins from the same serotype, for example Ad11, in particular Ad11p, for example found at positions 30811-31788, 18254-21100 and 13682-15367 of the genomic sequence of the latter.

Enadenotucirev (EnAd) is a chimeric oncolytic adenovirus, formerly known as ColoAd1 (WO2005/118825), with fibre, penton and hexon from Ad11p, hence it is a group B virus. It has a chimeric E2B region, which comprises DNA from Ad11p and Ad3. Almost all of the E3 region and part of the E4 region is deleted in EnAd.

E3 as employed herein refers to the DNA sequence encoding part or all of an adenovirus E3 region (i.e. protein/polypeptide), it may be mutated such that the protein encoded by the E3 gene has conservative or non-conservative amino acid changes, such that it has the same function as wild-type (the corresponding unmutated protein); increased function in comparison to wild-type protein; decreased function, such as no function in comparison to wild-type protein or has a new function in comparison to wild-type protein or a combination of the same, as appropriate. Where part of the E3 region is deleted (partly deleted in the E3 region) includes where 1 to 99% of the E3 region is deleted, such as 2, 3, 4, 5, 6, 7, 8, 9, 10, 15, 20, 25, 30, 35, 40, 45, 50, 55, 60, 65, 70, 75, 80, 85, 90, 91, 92, 93, 94 95, 96, 97 or 98% deleted, for example in a coding and/or non-coding region of the gene.

E4 as employed herein refers to the DNA sequence encoding an adenovirus E4 region (i.e. polypeptide/protein region), which may be mutated such that the protein encoded by the E4 gene has conservative or non-conservative amino acid changes, and has the same function as wild-type (the corresponding non-mutated protein); increased function in comparison to wild-type protein; decreased function, such as no function in comparison to wild-type protein or has a new function in comparison to wild-type protein or a combination of the same as appropriate.

The E4 region may have some function or functions relevant to viral replication and thus modifications, such as deletion of the E4 region may impact on a virus life-cycle and replication, for example such that a packaging cell may be required for replication.

In one embodiment E4 has the E4ORF4 region deleted.

"Derived from" as employed herein refers to, for example where a DNA fragment is taken from an adenovirus or corresponds to a sequence originally found in an adenovirus. This language is not intended to limit how the sequence was obtained, for example a sequence employed in a virus according to the present disclosure may be synthesised.

In one embodiment the derivative has 100% sequence identity over its full length to the original DNA sequence.

In one embodiment the derivative has 95, 96, 97, 98 or 99% identity or similarity to the original DNA sequence.

In one embodiment the derivative hybridises under stringent conditions to the original DNA sequence.

As used herein, "stringency" typically occurs in a range from about Tm (melting temperature)–50° C. (5° below the Tm of the probe) to about 20° C. to 25° C. below Tm. As will be understood by those of skill in the art, a stringent hybridization can be used to identify or detect identical polynucleotide sequences or to identify or detect similar or related polynucleotide sequences. As herein used, the term "stringent conditions" means hybridization will generally occur if there is at least 95%, such as at least 97% identity between the sequences.

As used herein, "hybridization" as used herein, shall include "any process by which a polynucleotide strand joins with a complementary strand through base pairing" (Coombs, J., *Dictionary of Biotechnology, Stockton Press, New York, N.Y.*, 1994).

Oncolytic viruses are those which preferentially infect cancer cells and hasten cell death, for example by lysis of same, or selectively replicate in the cancer cells. Viruses which preferentially infect cancer cells are viruses which show a higher rate of infecting cancer cells when compared to normal healthy cells.

Viruses which selectively replicate in cancer cells are those which require a gene or protein which is upregulated in a cancer cell to replicate, such as a p53 gene.

The E2B region is a known region in group B adenoviruses and represents about 18% of the viral genome. It is thought to encode protein IVa2, DNA polymerase and terminal protein. In the Slobitski strain of Ad11 (referred to as Ad11p) these proteins are encoded at positions 5588-3964, 8435-5067 and 10342-8438 respectively in the genomic sequence and the E2B region runs from 10342-3950. The exact position of the E2B region may change in other serotypes but the function is conserved in all human adenovirus genomes examined to date as they all have the same general organisation.

Replication capable as employed herein refers to a virus capable of replicating in vivo, including a virus with replication dependent on an upregulated gene in a diseased cell, such as p53, and replication competent viruses.

In one embodiment the virus is replication competent. Replication competent virus as employed herein refers to a virus that is capable of replication without the assistance of a complementary cell line encoding an essential viral protein, such as that encoded by the E1 region (also referred to as a packaging cell line) and a virus capable of replicating without the assistance of a helper virus.

Viral vectors as employed herein are replication deficient. Replication deficient viruses of the present disclosure require a packaging cell line to replicate. Packaging cell lines contain a gene or genes to complement those which are deficient in the virus.

In one embodiment the present disclosure provides a process of preparing a pharmaceutical formulation comprising the step of mixing a group B adenovirus (such as a replication competent group B virus) with 15 to 25% v/v of glycerol, 0.1 to 1.5% v/v of ethanol, a buffer (wherein the % v/v is the final formulation volume) and if required adjusting the pH to be in the range 8.0 to 9.5, for example 8.0 to 9.5 (or 8.5 to 9.5), such as 8.0 to 8.5 (or 8.5 to 9.)

In one embodiment the process further comprises the addition of 0.01 to 0.3 mM, for example 0.01 to 0.25 mM (or 0.01 to 2 mM), such as 0.25 mM (or 0.15 mM) methionine.

In one embodiment the formulation comprises a virus sequence disclosed in the associated sequence listing filed herewith.

Treatment

The patient recipient of the formulation according to the present disclosure, may be a human or animal, such as a domestic animal. In one embodiment the patient is a human, such as an adult human.

The formulation of present disclosure is suitable for formulation of replication capable (including replication competent) group B adenoviruses and replication deficient group B adenoviral vectors, for therapeutic and diagnostic applications, for example for gene therapy applications, vaccines, cancer treatment and the like.

In a further aspect the present disclosure extends to a formulation as described herein for use in treatment, in particular for the treatment of cancer.

In one embodiment the method of treatment is for use in the treatment of a tumour.

Tumour as employed herein is intended to refer to an abnormal mass of tissue that results from excessive cell division that is uncontrolled and progressive, also called a neoplasm. Tumours may be either benign (not cancerous) or malignant. Tumour encompasses all forms of cancer and metastases. In one embodiment the tumour is cancerous.

In one embodiment the tumour is a solid tumour. The solid tumour may be localised or metastasized.

In one embodiment the tumour is of epithelial origin.

In one embodiment the tumour is a malignancy, such as colorectal cancer, hepatoma, prostate cancer, pancreatic cancer, breast cancer, ovarian cancer, thyroid cancer, renal cancer, bladder cancer, head and neck cancer or lung cancer.

In one embodiment the tumour is a colorectal malignancy.

Malignancy as employed herein refers to cancerous cells.

In one embodiment the oncolytic adenovirus is employed in the treatment or prevention of metastasis.

In one embodiment the formulation herein is employed in the treatment of drug resistant cancers.

In one embodiment the virus is administered in combination with the administration of a further cancer treatment or therapy.

In one embodiment there is provided a formulation according to the present disclosure for use in the manufacture of a medicament for the treatment of cancer, for example a cancer described above.

In a further aspect there is provide a method of treating cancer comprising administering a therapeutically effective amount of a formulation according to the present disclosure to a patient in need thereof, for example a human patient.

In one embodiment the formulation herein is administered in combination with another therapy.

"In combination" as employed herein is intended to encompass where the formulation herein is administered before, concurrently and/or post cancer treatment or therapy. However, generally the treatment regimens for the combination therapy will generally overlap.

Cancer therapy includes surgery, radiation therapy, targeted therapy and/or chemotherapy.

Cancer treatment as employed herein also refers to treatment with a therapeutic compound or biological agent, for example an antibody intended to treat the cancer and/or maintenance therapy thereof.

In one embodiment the cancer treatment is selected from any other anti-cancer therapy including a chemotherapeutic agent; a targeted anticancer agent, such as an antibody drug conjugate; radiotherapy, radio-isotope therapy or any combination thereof.

In one embodiment the formulation of the present disclosure may be used as a pre-treatment to the therapy, such as a surgery (neoadjuvant therapy), to shrink the tumour, to treat metastasis and/or prevent metastasis or further metastasis. The formulation may be used after the therapy, such as a surgery (adjuvant therapy), to treat metastasis and/or prevent metastasis or further metastasis.

In one embodiment a formulation of the present disclosure is employed in maintenance therapy.

In one embodiment the formulation according to the present disclosure is administered in combination with, for example concurrently with, a cancer therapy.

Concurrently as employed herein is the administration of the additional cancer treatment at the same time or approximately the same time as the formulation. The treatment may be contained within the same formulation or administered as a separate formulation.

In one embodiment the virus is administered in combination, for example concurrently, with the administration of a chemotherapeutic agent.

Chemotherapeutic agent as employed herein is intended to refer to specific antineoplastic chemical agents or drugs that are selectively destructive to malignant cells and tissues. For example, alkylating agents, antimetabolites, anthracyclines, plant alkaloids, topoisomerase inhibitors, and other antitumour agents. Examples of specific chemotherapeutic agents include doxorubicin, 5-fluorouracil (5-FU), paclitaxel, capecitabine, irinotecan, and platins, such as cisplatin and oxaliplatin. The dose may be chosen by the practitioner based on the nature of the cancer being treated.

Combination Therapies & Chemotherapeutic Agents

The formulation of the present disclosure may be employed in combination with a further cancer therapy, for example chemotherapy.

Chemotherapeutic agent and chemotherapy or cytotoxic agent are employed interchangeably herein unless the context indicates otherwise.

Chemotherapy as employed herein is intended to refer to specific antineoplastic chemical agents or drugs that are "selectively" destructive to malignant cells and tissues, for example alkylating agents, antimetabolites including thymidylate synthase inhibitors, anthracyclines, anti-microtubule agents including plant alkaloids, topoisomerase inhibitors, parp inhibitors and other anti-tumour agents. Selectively in this context is used loosely because of course many of these agents have serious side effects.

The preferred dose may be chosen by the practitioner, based on the nature of the cancer being treated.

Examples of alkylating agents, which may be employed in the method of the present disclosure include an alkylating agent nitrogen mustards, nitrosoureas, tetrazines, aziridines, platins and derivatives, and non-classical alkylating agents.

Example a platinum containing chemotherapeutic agent (also referred to as platins), such as cisplatin, carboplatin, oxaliplatin, satraplatin, picoplatin, nedaplatin, triplatin and lipoplatin (a liposomal version of cisplatin), in particular cisplatin, carboplatin and oxaliplatin.

The dose for cisplatin ranges from about 20 to about 270 mg/m$^2$ depending on the exact cancer. Often the dose is in the range about 70 to about 100 mg/m$^2$.

Nitrogen mustards include mechlorethamine, cyclophosphamide, melphalan, chlorambucil, ifosfamide and busulfan. Nitrosoureas include N-Nitroso-N-methylurea (MNU), carmustine (BCNU), lomustine (CCNU) and semustine (MeCCNU), fotemustine and streptozotocin. Tetrazines include dacarbazine, mitozolomide and temozolomide.

Aziridines include thiotepa, mytomycin and diaziquone (AZQ).

Examples of antimetabolites, which may be employed in the method of the present disclosure, include anti-folates (for example methotrexate and pemetrexed), purine analogues (for example thiopurines, such as azathiopurine, mercaptopurine, thiopurine, fludarabine (including the phosphate form), pentostatin and cladribine), pyrimidine analogues (for example fluoropyrimidines, such as 5-fluorouracil and prodrugs thereof such as capecitabine [Xeloda®]), floxuridine, gemcitabine, cytarabine, decitabine, raltitrexed (Tomudex®) hydrochloride, cladribine and 6-azauracil.

Examples of anthracyclines, which may be employed in the method of the present disclosure, include daunorubicin (Daunomycin), daunorubicin (liposomal), doxorubicin (Adriamycin), doxorubicin (liposomal), epirubicin, idarubicin, valrubicin currently used only to treat bladder cancer and mitoxantrone an anthracycline analog, in particular doxorubicin.

Examples of anti-microtubule agents, which may be employed in the method of the present disclosure, include vinca alkaloids and taxanes.

Vinca alkaloids include completely natural chemicals for example vincristine and vinblastine and also semi-synthetic vinca alkaloids, for example vinorelbine, vindesine, and vinflunine.

Taxanes include paclitaxel, docetaxel, Abraxane®, carbazitaxel and derivatives of thereof. Derivatives of taxanes as employed herein includes reformulations of taxanes like Taxol, for example in a micellar formulations, derivatives also include chemical derivatives wherein synthetic chemistry is employed to modify a starting material which is a taxane.

Topoisomerase inhibitors, which may be employed in a method of the present disclosure include type I topoisomerase inhibitors, type II topoisomerase inhibitors and type II topoisomerase poisons. Type I inhibitors include topotecan, irinotecan, indotecan and indometacin. Type II inhibitors include genistein and ICRF 193 which has the following structure:

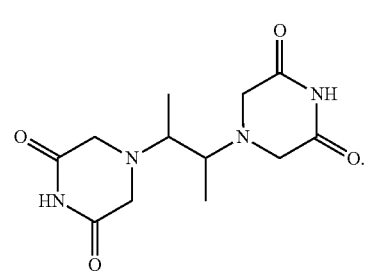 [SMILES: CC(C(C)N1CC(=O)NC(=O)C1)N1CC(=O)NC(=O)C1]

Type II poisons include amsacrine, etoposide, etoposide phosphate, teniposide and doxorubicin and fluoroquinolones.

In one embodiment a combination of chemotherapeutic agents employed is, for example a platin and 5-FU or a prodrug thereof, for example cisplatin or oxaplatin and capecitabine or gemcitabine, such as FOLFOX.

In one embodiment the chemotherapy comprises a combination of chemotherapy agents, in particular cytotoxic chemotherapeutic agents.

In one embodiment the chemotherapy combination comprises a platin, such as cisplatin and fluorouracil or capecitabine.

In one embodiment the chemotherapy combination in capecitabine and oxaliplatin (Xelox).

In one embodiment the chemotherapy is a combination of folinic acid and 5-FU, optionally in combination with oxaliplatin.

In one embodiment the chemotherapy is a combination of folinic acid, 5-FU and irinotecan (FOLFIRI), optionally in combination with oxaliplatin (FOLFIRINOX). The regimen consists of: irinotecan (180 mg/m 2 IV over 90 minutes) concurrently with folinic acid (400 mg/m 2 [or 2×250 mg/m 2] IV over 120 minutes); followed by fluorouracil (400-500 mg/m 2 IV bolus) then fluorouracil (2400-3000 mg/m 2 intravenous infusion over 46 hours). This cycle is typically repeated every two weeks. The dosages shown above may vary from cycle to cycle.

In one embodiment the chemotherapy combination employs a microtubule inhibitor, for example vincristine sulphate, epothilone A, N-[2-[(4-Hydroxyphenyl)amino]-3-pyridinyl]-4-methoxybenzenesulfonamide (ABT-751), a Taxol derived chemotherapeutic agent, for example paclitaxel, abraxane, or docetaxel or a combination thereof.

In one embodiment the combination employs an mTor inhibitor. Examples of mTor inhibitors include: everolimus (RAD001), WYE-354, KU-0063794, papamycin (Sirolimus), Temsirolimus, Deforolimus (MK-8669), AZD8055 and BEZ235 (NVP-BEZ235).

In one embodiment the combination employs a MEK inhibitor. Examples of MEK inhibitors include: AS703026, CI-1040 (PD184352), AZD6244 (Selumetinib), PD318088, PD0325901, AZD8330, PD98059, U0126-EtOH, BIX 02189 or BIX 02188.

In one embodiment the combination employs an AKT inhibitor. Examples of AKT inhibitors include: MK-2206 and AT7867.

In one embodiment the combination employs an aurora kinase inhibitor. Examples of aurora kinase inhibitors include: Aurora A Inhibitor I, VX-680, AZD1152-HQPA (Barasertib), SNS-314 Mesylate, PHA-680632, ZM-447439, CCT129202 and Hesperadin.

In one embodiment the combination employs a p38 inhibitor, for example as disclosed in WO2010/038086, such as N-[4-({4-[3-(3-tert-Butyl-1-p-tolyl-1H-pyrazol-5-yl)ureido]naphthalen-1-yloxy}methyl)pyridin-2-yl]-2-m ethoxyacetamide.

In one embodiment the combination employs a pi3K inhibitor, for example selected from dactolisib, pictilisib, LY294002, idelalsib, buparlisib, autophinib, serabelisib, IP1-549, SF2534, GDC-0326, SAR405, TGR-1202, VPS34, GSK2269557, 740 Y-P, PI-103, NU7441, TGX-221, IC-87114, wormannin, XL147 analogue, ZSTK474, alpelisib, AS-605240, PIK-75, 3-methyladenine, A66, voxtalisib, PIK-93, AZD6482, PF-04691502, apitolisib, GSK105965, duvelisib, TG100-115, AS-252424, BGT226, CUDU-907, PIK-294, AS-604850, GSK2636771, copanlisib, YM201636, CH5132799, CAY10505, PIK-293, TG100713, VS-5584, taselisib, CZC24832, AMG319, GSK2292767, GDC-0084, HS-173, quercetin, voxtalisib, GNE-317, LY3023414, VPS34-IN1, PIK-III, PI-3065, pilaralisib, AZD8835, PF-4989216 and AZD8186.

In one embodiment the combination employs a Bcl-2 inhibitor. Examples of Bcl-2 inhibitors include: obatoclax mesylate, ABT-737, ABT-263 (navitoclax) and TW-37.

In one embodiment the chemotherapy combination comprises an antimetabolite such as capecitabine (Xeloda®), fludarabine phosphate, fludarabine (Fludara), decitabine, raltitrexed (Tomudex®), gemcitabine hydrochloride and cladribine.

In one embodiment the combination comprises ganciclovir, which may assist in controlling immune responses and/or tumour vasculation.

In one embodiment the combination comprises a PARP inhibitor.

In one embodiment the therapeutic agent is ganciclovir, which may assist in controlling immune responses and/or tumour vascularisation.

In one embodiment one or more therapies employed in the method herein are metronomic, that is a continuous or frequent treatment with low doses of anticancer drugs, often given concomitant with other methods of therapy.

Subgroup B oncolytic adenoviruses (in particular Ad11 and those derived therefrom, such as EnAd) may be particularly synergistic with chemotherapeutics because they seem to have a mechanism of action that is largely independent of apoptosis, killing cancer cells by a predominantly necrolytic mechanism. Moreover, the immunosuppression that occurs during chemotherapy may allow the oncolytic virus to function with greater efficiency.

Therapeutic dose as employed herein refers to the amount of virus, such as oncolytic adenovirus that is suitable for achieving the intended therapeutic effect when employed in a suitable treatment regimen, for example ameliorates symptoms or conditions of a disease, in particular without eliciting dose limiting side effects. A dose may be considered a therapeutic dose in the treatment of cancer or metastases when the number of viral particles may be sufficient to result in the following: tumour or metastatic growth is slowed or stopped, or the tumour or metastasis is found to shrink in size, and/or the life span of the patient is extended. Suitable therapeutic doses are generally a balance between therapeutic effect and tolerable toxicity, for example where the side-effect and toxicity are tolerable given the benefit achieved by the therapy.

In one embodiment there is provided systemically administering multiple doses of a parenteral formulation of an oncolytic adenovirus according to the present disclosure in a single treatment cycle, for example wherein the total dose given in each administration is in the range of $1 \times 10^{10}$ to $1 \times 10^{11}$ viral particles per dose.

In one embodiment one or more doses (for example each dose) of virus or composition comprising the same is administered such that the rate of viral particle delivery is in the range of $2 \times 10^{10}$ particles per minute to $2 \times 10^{12}$ particles per minute.

In one embodiment a virus or therapeutic construct according to the present disclosure (including a formulation comprising same) is administered weekly, for example on week 1 the dose is administered on day 1, 3, 5, followed by one dose each subsequent week.

In one embodiment a virus or therapeutic construct according to the present disclosure (including a formulation comprising same) is administered bi-weekly or tri-weekly, for example is administered in week 1 one on days 1, 3 and 5, and on week 2 or 3 is also administered on days 1, 3 and 5 thereof. This dosing regimen may be repeated as many times as appropriate.

In one embodiment a formulation according to the present disclosure (including a formulation comprising same) is administered monthly, for example in a treatment cycle or as maintenance therapy.

In one embodiment the viruses and constructs of the present disclosure are prepared by recombinant techniques.

The skilled person will appreciate that the armed adenovirus genome can be manufactured by other technical means, including entirely synthesising the genome or a plasmid comprising part of all of the genome. The skilled person will appreciate that in the event of synthesising the genome the region of insertion may not comprise the restriction site nucleotides as the latter are artefacts following insertion of genes using cloning methods.

In one embodiment the armed adenovirus genome is entirely synthetically manufactured.

In the context of this specification "comprising" is to be interpreted as "including".

Embodiments of the invention comprising certain features/elements are also intended to extend to alternative embodiments "consisting" or "consisting essentially" of the relevant elements/features.

Where technically appropriate, embodiments of the invention may be combined. Technical references such as patents and applications are incorporated herein by reference.

Any embodiments specifically and explicitly recited herein may form the basis of a disclaimer either alone or in combination with one or more further embodiments.

Heading herein are employed to divide the document into sections and are not intended to be used to construe the meaning of the disclosure provided herein.

The present application claims priority from GB 1801614.7, filed 31 Jan. 2018, and incorporated herein by reference. The priority application may be employed as the basis for correction to the present specification.

The present invention is further described by way of illustration only in the following examples.

BRIEF DESCRIPTION OF THE FIGURES

FIG. 1 shows results of experiments comparing the stability of group B adenoviruses in different buffers across a range of different pH values. (A) stability of adenoviruses stored at 2-8 for 20 months (B) stability of group B adenoviruses stored at 25° C. for 8 weeks.

FIG. 2 shows the results of experiments to determine the effect of glycerol on the stability of group B adenoviruses. (A) graphs show stability of group B adenoviruses at week 0, week 7 and week 17 across a range of different glycerol concentrations ranging from 8 to 20%. (B) graph showing role of glycerol in polydispersity over 7 weeks. (C) graph showing % change in concentration of group B adenoviruses in formulations containing 0%, 10% and 20% glycerol as measured by HPLC assay.

FIG. 3 shows results of experiments to ascertain ethanol/arginine/methionine/polysorbate contribute to stability of group B adenoviruses. (A) graph showing potency of a group B adenovirus over time for different buffers. (B) graph showing concentration of a group B adenoviruses over time for different buffers. (C) graph showing concentration of a control formulation comprising glycerol, HEPES buffer, ethanol, arginine, methionine and polysorbate over time.

FIG. 7 shows the relative retention times of Ad5 (a group C virus) and Ad11 (a group B virus) analysed by anion exchange chromatography.

FIG. 8C shows oncolytic relative potency analysis (20% glycerol, 1.4% ethanol, 15 mM arginine, 0.25 mM methionine).

FIG. 8D shows virus concentration by AEX-HPLC (20% glycerol, 1.4% ethanol, 15 mM arginine, 0.25 mM methionine)

SEQUENCES

Figure 4:
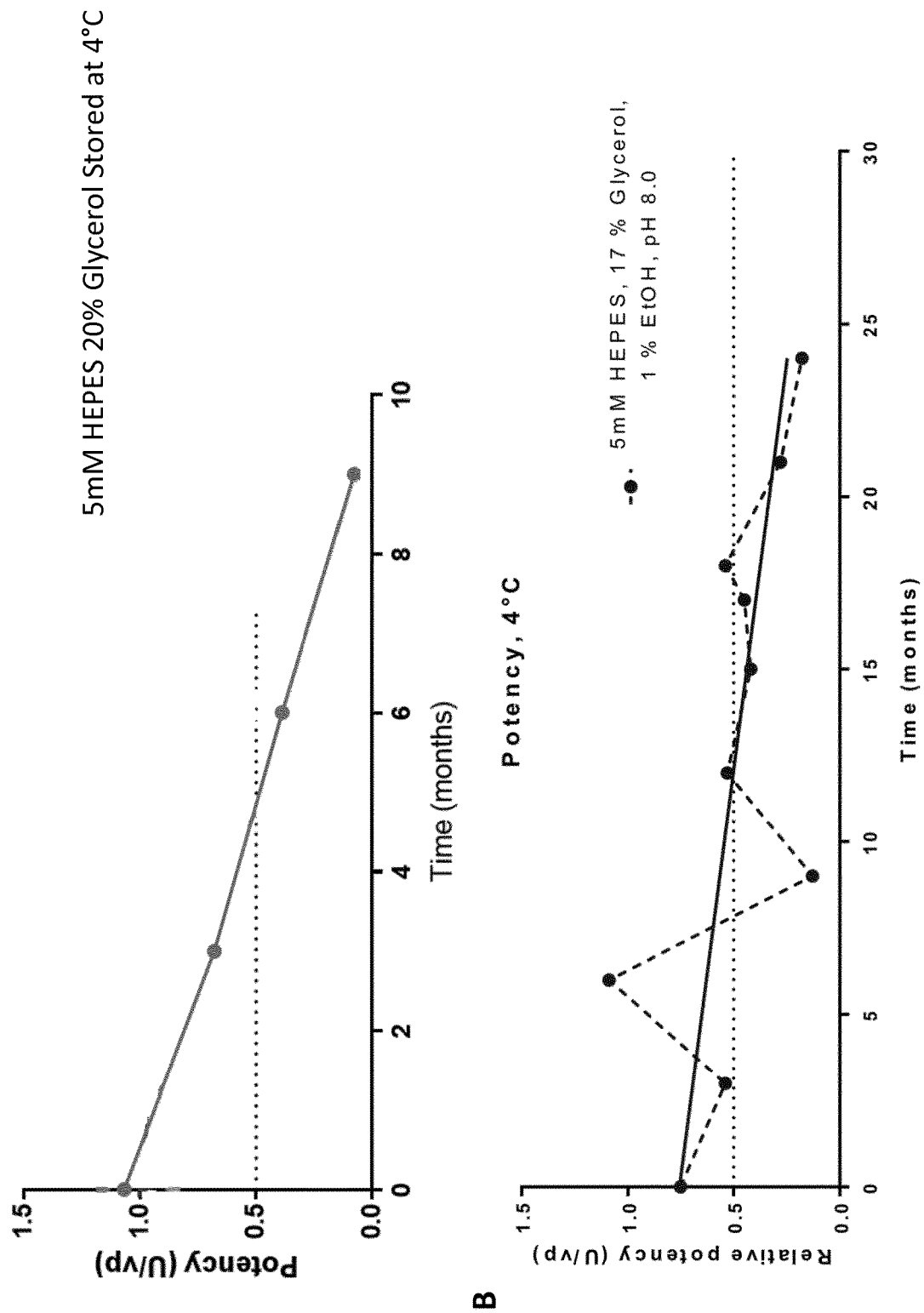
FIG. 4 shows results of experiments showing impact of ethanol, arginine and methionine on potency of adenoviruses during long term storage at 4° C. (A) shows the potency of group B adenovirus in 5 mM HEPES with 20% glycerol (B) graph showing effect on relative potency when ethanol is included in formulation. (C) graph showing effect on relative potency when ethanol and methionine are included in formulation. (D) graph showing effect on relative potency when ethanol, methionine and arginine are included in formulation. (E) graph showing concentration of adenoviruses over time for formulations tested in FIGS. 4B-4D.
Figure 4:
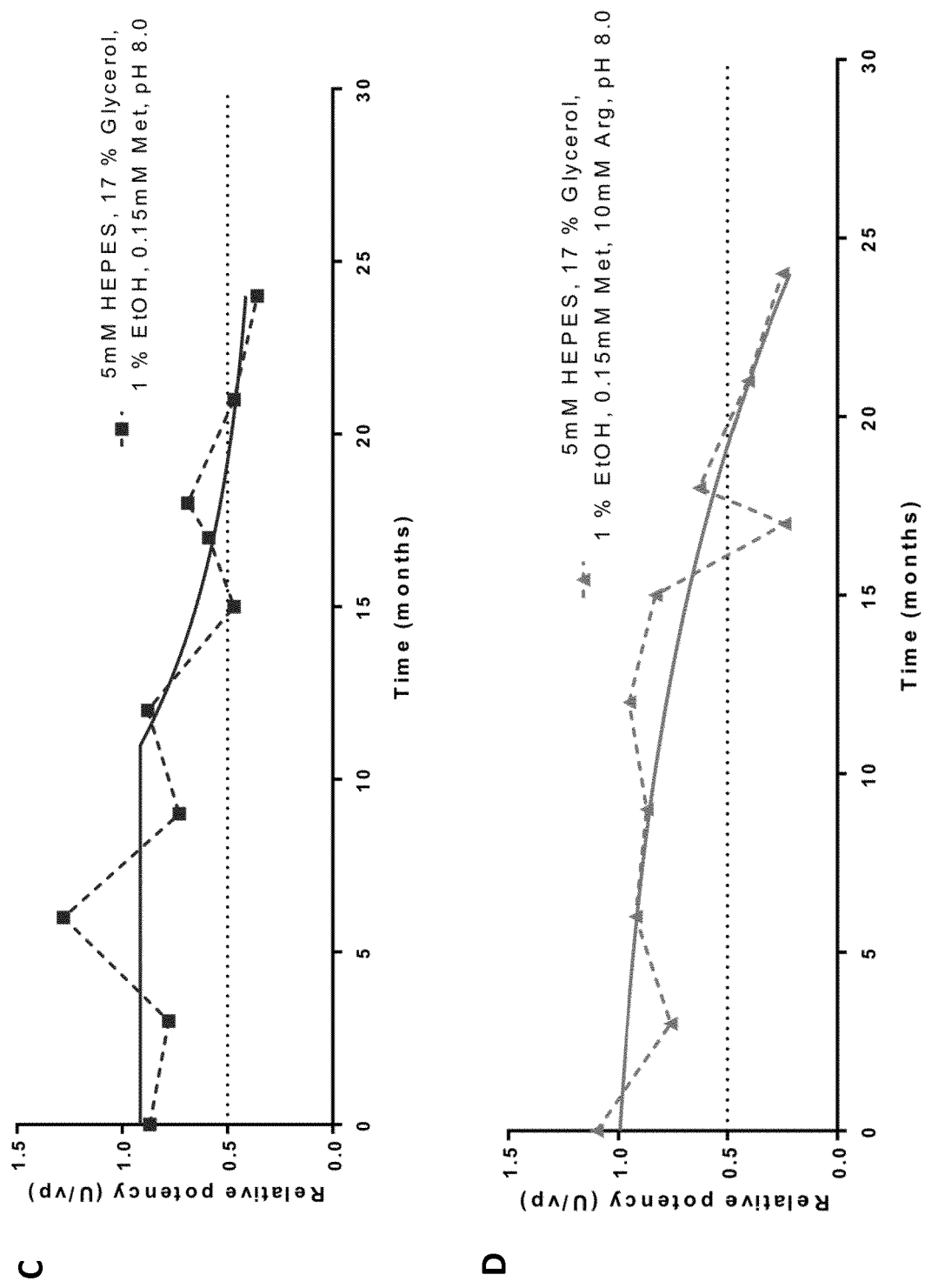
Figure 4:
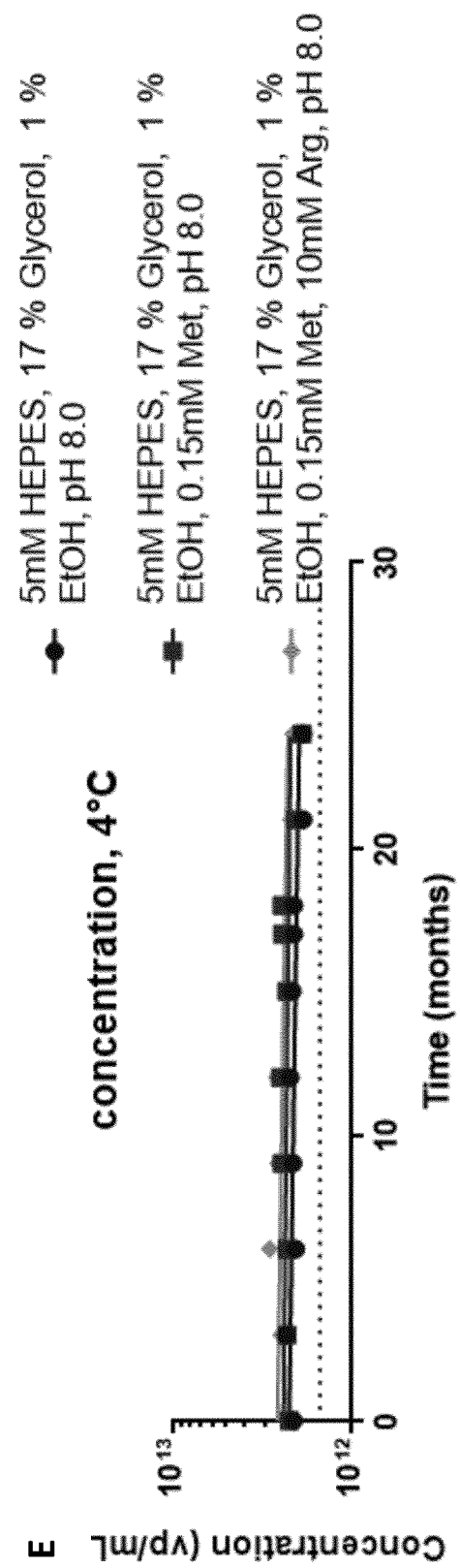

SEQ ID NO: 1 Splice Acceptor (SA); SEQ ID NO: 2 Branched Splice Acceptor (BSA); SEQ ID NO: 3

Internal Ribosome Entry sequence (IRES); SEQ ID NO: 4 Polyadenylation sequence SEQ ID NO: 5 BX DNA sequence corresponding to and including bp 28166-28366 of the EnAd genome; SEQ ID NO: 6 BY DNA sequence corresponding to and including bp 29345-29379 of the EnAd genome; SEQ ID NO: 7 Leader Sequence; SEQ ID NO: 8 Leader Sequence; SEQ ID NO: 9

P2A peptide; SEQ ID NO: 10 F2A peptide; SEQ ID NO: 11 E2A peptide; SEQ ID NO: 12 2A peptide; SEQ ID NO: 13 EnAd genome; SEQ ID NO: 14 NG-73 virus Genome Sequence; SEQ ID NO: 15 NG-74 virus Genome Sequence; SEQ ID NO: 16 NG-76 virus Genome Sequence; SEQ ID NO: 17 NG-77 virus Genome Sequence; SEQ ID NO: 18 NG-78 virus genome sequence SEQ ID NO: 19 NG-92 virus genome sequence; SEQ ID NO: 20 NG-95 virus genome sequence; SEQ ID NO: 21 NG-96 virus genome sequence; SEQ ID NO: 22 NG-97 virus genome sequence; SEQ ID NO: 23 NG-134 virus genome sequence; SEQ ID NO: 24 NG-135 virus genome sequence; SEQ ID NO: 25 NG-139 virus genome sequence consisting of a transgene cassette that encodes the cytokine, TNFα, inserted in the region BY; SEQ ID NO: 26 A virus genome sequence consisting of a transgene cassette that encodes an anti-VEGF full length antibody inserted in the region BY. The transgene cassette contains a SSA, ab heavy chain sequence with 5' leader, a SSA, and ab light chain sequence; SEQ ID NO: 27 A virus genome sequence consisting of a transgene cassette that encodes an anti-VEGF full length antibody inserted in the region BY; SEQ ID NO: 28 NG-165 virus genome sequence consisting of a transgene cassette encoding an anti-VEGF full length antibody inserted into the region BY; SEQ ID NO: 29 NG-167 virus genome sequence consisting of a transgene cassette that encodes an anti-VEGF ScFv with a C-terminal His6 tag, inserted in the region BY; SEQ ID NO: 30 NG-177 virus genome sequence consisting of a transgene cassette encoding an anti-PD-L1 full length antibody inserted into the region BY; SEQ ID NO: 31 NG-185 virus genome sequence consisting of the EnAd genome with unique restriction sites inserted into the BX and BY regions; SEQ ID NO: 32 NG-190 virus genome sequence consisting of a transgene cassette encoding an anti-PD-L1 full length antibody inserted into the region BY; SEQ ID NO: 33 NG-217 virus genome sequence consisting of a transgene cassette that encodes the tumour associated antigen, NY-ESO-1, inserted in the region BY; SEQ ID NO: 34 NG-220 virus genome sequence consisting of a transgene cassette that encodes the tumour associated antigen, NY-ESO-1, inserted in the region BY; SEQ ID NO: 35 NG-221 virus genome sequence consisting of the EnAd genome with a transgene cassette that encodes an anti-PD-L1 ScFv with a C-terminal His6 tag, inserted in the region BY; SEQ ID NO: 36 NG-242 virus genome sequence consisting of a transgene cassette encoding an anti-CTLA-4 full length antibody inserted into the region BY; SEQ ID NO: 37 NG-257 virus genome sequence comprising the EnAd genome with a transgene cassette encoding an anti-VEGF ScFv inserted into the region BX; SEQ ID NO: 38 NG258 virus genome sequence consisting of a transgene cassette encoding an anti-VEGF full length antibody inserted into the region BY; SEQ ID NO: 39 NG-272 virus genome sequence comprising the EnAd genome with a transgene cassette encoding an anti-VEGF ScFv and an anti-PD-L1 ScFv inserted into the region BY; SEQ ID NO: 40 NG-280 virus genome sequence consisting of a transgene cassette encoding the sodium iodide symporter (NIS) inserted into the region BY; SEQ ID NO: 41 NG-281 virus genome sequence comprising the EnAd genome with a transgene cassette encoding an anti-VEGF ScFv inserted into the region BX and a second transgene cassette encoding an anti-PD-L1 ScFv inserted into the region BY; SEQ ID NO: 42 NG-330 virus genome sequence comprising the EnAd genome with a transgene cassette that encodes the T lymphocyte activation antigen, CD80, inserted in the region BY. The transgene cassette contains a 5' SSA, human CD80 cDNA sequence and a 3' poly(A) sequence; SEQ ID NO: 43 NG-343 virus genome sequence comprising the EnAd genome with a transgene cassette that encodes IFNα, and CD80, inserted in the region BY. The transgene cassette contains a 5' SSA, IFNα cDNA sequence, P2A peptide, CD80 cDNA sequence and a 3' poly(A) sequence; SEQ ID NO: 44 NG-641 genome; SEQ ID NO: 45 NG-345 virus genome sequence comprising the EnAd genome with a transgene cassette that encodes Flt3 Ligand, MIP1α and IFNα, inserted in the region BY. The transgene cassette contains a 5' SSA, Flt3 Ligand cDNA sequence, P2A peptide sequence, MIP1α cDNA sequence, T2A peptide sequence, IFNα cDNA sequence and a 3' poly(A) sequence; SEQ ID NO: 46 NG-346 virus genome sequence comprising the EnAd genome with a transgene cassette that encodes Flt3 Ligand, MIP1α and CD80, inserted in the region BY. The transgene cassette contains a 5' SSA, Flt3 Ligand cDNA sequence, P2A peptide sequence, MIP1α cDNA sequence, T2A peptide sequence, CD80 cDNA sequence and a 3' poly(A) sequence; SEQ ID NO: 47 NG-347 virus genome sequence comprising the EnAd genome with a transgene cassette that encodes IFNα, MIP1α and CD80, inserted in the region BY. The transgene cassette contains a 5' SSA, IFNα cDNA sequence, P2A peptide sequence, MIP1α cDNA sequence, T2A peptide sequence, CD80 cDNA sequence and a 3' poly(A) sequence; SEQ ID NO: 48 NG-348 virus genome sequence comprising the EnAd genome with a transgene cassette that encodes a membrane-anchored chimeric form of the single chain Fv anti-human CD3e and the T lymphocyte activation antigen, CD80 inserted in the region BY. The transgene cassette contains a 5' SSA, membrane-anchored anti-CD3ε cDNA sequence, P2A peptide, human CD80 cDNA sequence and a 3' poly(A) sequence; SEQ ID NO: 49 NG-348A virus genome sequence comprising the EnAd genome with a transgene cassette that encodes a membrane-anchored chimeric form of the single chain Fv anti-human CD3e with C-terminal V5 tag and the T lymphocyte activation antigen, CD80 inserted in the region BY. The transgene cassette contains a 5' SSA, membrane-anchored anti-CD3ε cDNA sequence, V5 tag, P2A peptide, human CD80 cDNA sequence and a 3' poly(A) sequence; SEQ ID NO: 50 NG-350A genome sequence; SEQ ID NO: 51 NG-420 virus genome sequence comprising the EnAd genome with a transgene cassette that encodes a membrane-anchored chimeric form of the single chain Fv anti-human CD3e inserted in the region BY. The transgene cassette contains a 5' SSA, membrane-anchored anti-CD3ε cDNA sequence and a 3' poly(A) sequence; SEQ ID NO: 52 NG-420A virus genome sequence comprising the EnAd genome with a transgene cassette that encodes a membrane-anchored chimeric form of the single chain Fv anti-human CD3e and a C-terminal V5 tag, inserted in the region BY. The transgene cassette contains a 5' SSA, membrane-anchored anti-CD3ε cDNA sequence, V5 tag sequence and a 3' poly(A) sequence; SEQ ID NO: 53 NG-601 (EnAd-CMV-EpCAMBiTE); SEQ ID NO: 54 NG-602 (EnAd-SA-EpCAMBiTE); SEQ ID NO: 55 NG-605 (EnAd-CMV-FAPBiTE); SEQ ID NO: 56 NG-606 (EnAd-SA-FAPBiTE); SEQ ID NO: 57 NG-611 genome; SEQ ID NO: 58 NG-612 genome; SEQ ID NO: 59 NG-613 genome; SEQ ID NO: 60 NG-614 genome; SEQ ID NO: 61 NG-615 genome; SEQ ID NO: 62 NG-616 genome; SEQ ID NO: 63 NG-617 genome; SEQ ID NO: 64 NG-618 genome; SEQ ID NO: 65 NG-640 Genome.

EXAMPLES

Example 1—Testing Influence of pH on Stability of Adenoviral Formulations

An experiment was conducted to determine the influence of pH on the stability of group B adenoviral formulations. Different buffers were tested: carbonate/bicarbonate, diethnolamine, Gly-NaCl, HEPEs, meglumine, sodium borate and Tris buffer. Each buffer was produced with a range of different pH values: 8.0, 8.5, 9.0, 9.5 and 10.0. Each buffer also contained glycerol, ethanol, arginine, methionine and polysorbate. EnAd was suspended in each buffer and the formulations were stored at 4° C. Samples from each formulation were taken at regular intervals and the stability of the adenoviruses in each formulation determined by measuring the concentration of viral DNA in the sample using HPLC. A lower concentration of DNA was strong indicative of higher levels of viral degradation and hence lower stability.

The results of the experiment are shown in FIG. 1. As can be seen from FIG. 1, panel A, the pH has a significant effect on the stability of the adenoviruses. Peak stability was observed at pH 9.0 and this dropped noticeably when pH was dropped to 8.0 or raised to 10.0. A similar effect was also observed for short term (up to 8 weeks) storage at 25° C. (FIG. 1, panel B). Importantly, although there are slight variances in stability between the different buffers, the influence of pH was far more important, and the formulations which deviated the furthest from the 9.0 pH had the lowest stability regardless of which buffer was used in the formulation. The results therefore suggest that a pH of between 8.5 to 9.5 provides the best stability.

Example 2—Testing Influence of Glycerol on Stability of Adenoviral Formulations

A series of experiments were conducted to determine the effect on the stability of group B adenoviral formulations when glycerol was included in the formulations. Glycerol was screened in combination using a Definitive Screening Design (DSD) at three concentrations: 9%, 14% and 20%. The results were analysed using SAS JMP statistical software. A model was created based on the DSD data. Each formulation also contained 10 mM HEPES. The adenoviruses were suspended in each formulation and the formulations were stored at 4° C. for a period of 17 weeks. The stability of the formulations was assessed at 0 weeks, 7 weeks and 17 weeks by measuring viral DNA concentration in samples using HPLC.

The results are shown in FIG. 2, panel A. As can be seen, there is a clear correlation between glycerol concentration and stability, with the formulations having higher glycerol concentrations having higher stability. The effect appears to taper off around the 17-20% glycerol concentration mark, suggesting that going beyond 20% glycerol is unlikely to produce a significant impact on stability. These results therefore suggest that a glycerol concentration of between 15-20% will significantly enhance stability and that a concentration of about 19 to 20% will likely produce the best results.

FIG. 2, panels B and C show the results of additional studies wherein 0%, 10% and 20% glycerol formulations were assessed after storage at 37° C. (FIG. 2, panel B) and storage at 25° C. FIG. 2, panel B shows that the polydispersity (which is a measure of the distribution of molecular mass within a solution—higher polydispersity correlates with higher degradation of the group B adenoviruses) was significantly higher when glycerol was excluded from the formulation compared to when 10% or 20% glycerol was added. FIG. 2, panel C shows the % change in group B adenovirus concentration over time and clearly shows a steeper and more drastic decline in concentration levels when no glycerol is used compared to when 10% or 20% glycerol was added to the formulations. Hence, these results also corroborate the findings in FIG. 2, panel A, i.e. that the inclusion of glycerol to the formulations has a significant effect on stability.

Example 3—Testing Effect of Addition of Ethanol/Arginine/Methionine/Polysorbate on Stability of Group B Adenoviral Formulations A series of experiments were conducted to determine the effect on the stability of group B adenoviral formulations when ethanol/arginine/methionine/polysorbate was omitted from the formulations. A range of different buffers were tested: HEPES 5 mM, meglumine 10 mM, TRIS 10 mM and Gly-NaCl 10 mM. None of the formulations contained any ethanol, arginine, methionine or polysorbate. The group B adenoviruses were suspended in each formulation and the formulations were stored at 4° C. for a period of 9 months. The stability and potency of the formulations were respectively assessed by HPLC and by MTS (a cell viability assay, which assesses the ability of the adenoviruses to lyse cells) at 3 month intervals, i.e. at 0 months, 3 months, 6 months and 9 months.

FIG. 3, panel A shows the potency of the group B adenoviruses over the 9 month storage period. As can be seen, there is significant degradation of the group B adenoviruses over this time frame, with the majority of the formulations approaching 0 U/vp potency by the 9 month mark. A notable exception is the meglumine containing formulation, but even this formulation was not spared from a significant drop to about 0.5 U/vp from the original starting level of 1 U/vp, i.e. the potency of the group B adenoviruses in the formulation was halved after 9 months. This result suggests that the meglumine buffer was the best at preserving the potency of the group B adenoviruses and also highlights the importance of including ethanol, arginine, methionine and polysorbate in the formulations.

FIG. 3, panel B shows the concentration levels of the group B adenoviruses over the 9 month period and again shows a trend wherein there is a significant decrease in concentration over the 9 month period for all the formulations tested. For comparison, FIG. 3, panel C shows the concentration of the group B adenoviruses in a formulation which contains ethanol/arginine/methionine/polysorbate. Note the stable group B adenovirus concentrations observed even after 20 months of storage at 4° C. Based on FIG. 3, panel B, at least with respect to concentration levels, it appears that the TRIS buffer performed the best. This experiment also shows that these components are important for overall stability of the formulations.

Example 4—Testing Individual Impact of Ethanol, Arginine and Methionine on Stability of Adenoviral Formulations Following the results of Example 3, further experiments were conducted in an attempt to determine the relative impact of each of ethanol, arginine and methionine on the stability of the group B adenovirus formulations during long term storage (24 months) at 4° C.

The results of the MTS assays are shown in FIG. 4. Three different formulations were tested, the first which included 1% ethanol (FIG. 4, panel A), the second which included 1% ethanol and 0.15 mM methionine (FIG. 4, panel C) and the third which included 1% ethanol, 0.15 mM methionine and 10 mM arginine (FIG. 4, panel B). All the formulations tested contained 5 mM HEPES, 17% glycerol and were at pH 8.0.

The results suggest that the potency of the group B adenoviruses is preserved by all 3 components in comparison with a control formulation which only had HEPES and glycerol and did not contain any of these components. The potency of the control formulation dropped to 0.5 U/vp within 3 months, whereas FIG. 4, panels A to C suggest that the period of stability is significantly extended when the 3 components are added. Specifically, the results suggest that the addition of ethanol extends the stability of the formulation by about 6 months, the addition of ethanol and methionine improves stability by about 15 months and the addition of ethanol, methionine and arginine improves stability by about 12 months. Accordingly, these results indicate that ethanol, methionine and arginine all contribute to stability.

FIG. 4, panel D shows the adenovirus concentration levels as determined by HPLC and suggests that the virus concentration remains approximately constant for all 3 formulations throughout the 24 months storage period. This perhaps suggests that ethanol has the biggest impact given that ethanol is present in all 3 formulations.

Example 5—Testing Effect of Polysorbate on Stability of Group B Adenoviral Formulations This example describes the results of an experiment to assess the importance of polysorbate on adenoviral formulation stability during long term storage (20 months) at 4° C. Two formulations were tested, one with 0.115% polysorbate 80 and the other with 0.15% polysorbate 80. Both formulations also contained 20% glycerol, 5 mM HEPES, 1.5% ethanol, 10 mM arginine, 0.2 mM methionine and were at pH 8.0.

Figure 5:
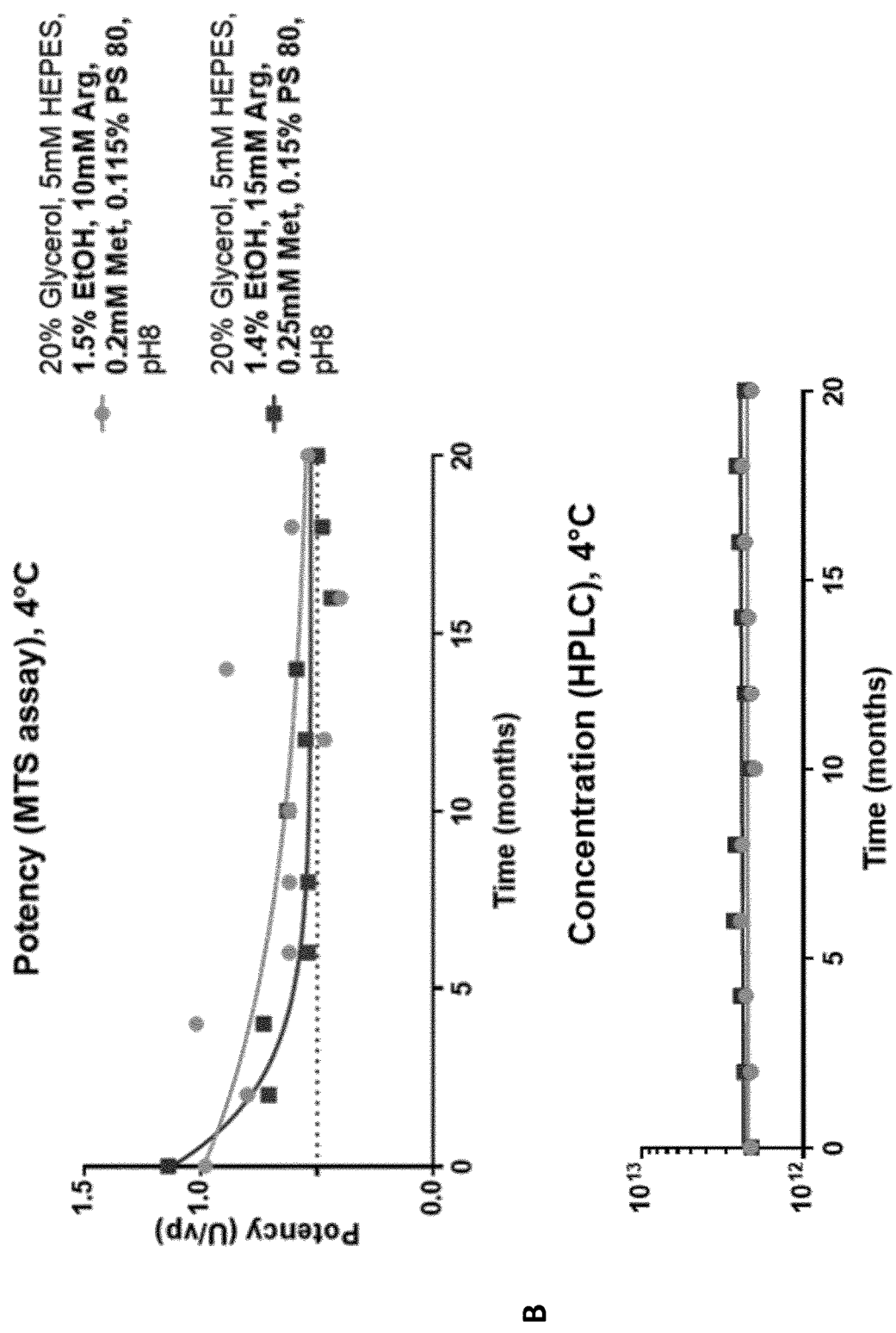
FIG. 5 shows results of experiments to assess effect of polysorbate on stability of adenoviruses. (A) graph showing potency of adenoviruses over time when 0.115% polysorbate is included in formulation vs 0.15% polysorbate. (B) graph showing concentration of adenoviruses over time when 0.115% polysorbate is included in formulation vs 0.15% polysorbate.

The results of the experiment are shown in FIG. 5. FIG. 5, panel A shows that the potency of the formulations gradually drops to about 0.5 U/vp around the 10 months mark for the formulation containing 0.15% polysorbate but then remains stable at 0.5 U/vp all the way to the 20 month point. Hence, polysorbate appears to make a significant contribution to preserving adenoviral potency in the formulations. The drop in potency is similar for the formulation containing 0.115%. This suggests that keeping the polysorbate around 0.1% results in a formulation with good stability.

FIG. 5, panel B shows the adenovirus concentration levels as determined by HPLC and suggests that the virus concentration remains fairly constant for both formulations throughout the 20 months storage period.

Example 6—Testing Different Buffers and their Impact on Stability of Group B Adenoviral Formulations This example describes the results of an experiment to compare the stability of different buffers when used in the group B adenoviral formulations during short term storage (11 weeks) at 25° C. 7 different formulations were tested: Gly-NaCl at pH 9.0, TRIS at pH 8.0, TRIS at pH 8.8, meglumine at pH 8.0, meglumine at pH 8.5, meglumine at pH 9.0 and HEPES at pH 8.0. All of the formulations contained 20% glycerol, 1.4% ethanol, 15 mM arginine, 0.15 or 0.25 mM methionine, 0.15% polysorbate.

Figure 6A:
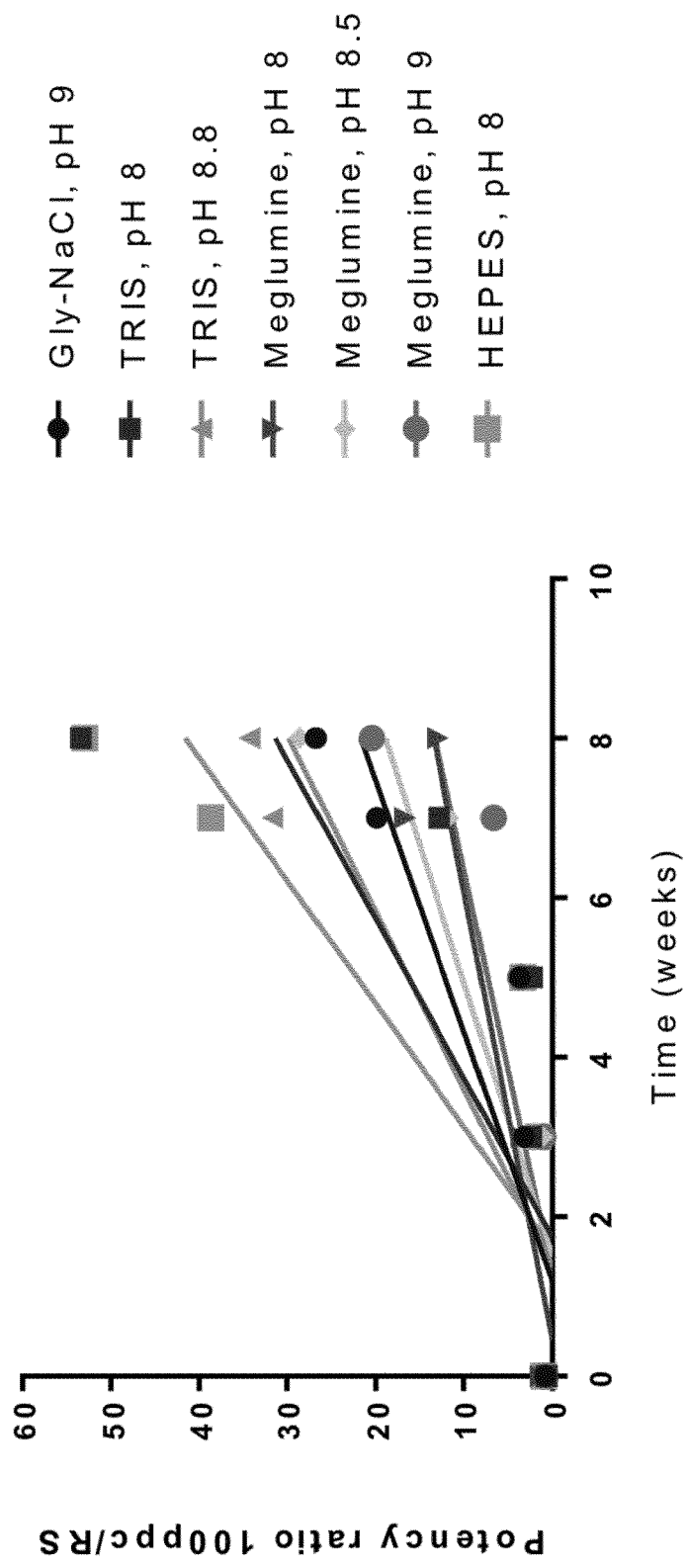
FIGS. 6A and 6B show the results of experiments to assess the stability of adenoviruses stored in different formulations at 25° C. over a 10 week time frame. (6A) potency of adenoviruses stored in different formulations over a 10 week time frame at 25° C. (6B) concentration of adenoviruses stored in different formulations over a 10 week time frame at 25° C.
Figure 6B:
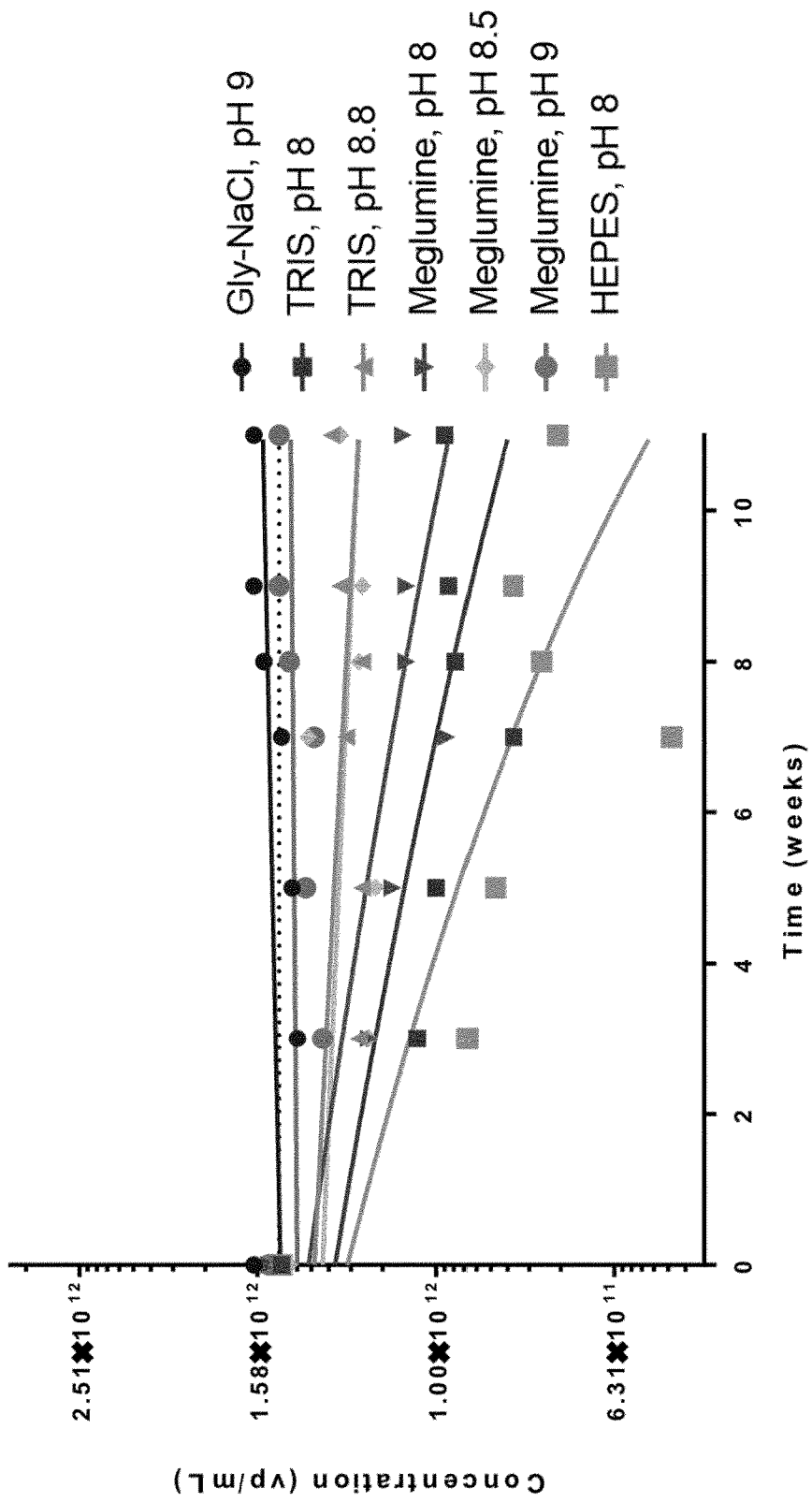

The results are shown in FIGS. 6A and 6B. FIG. 6A shows the potency ratio (100 ppc/RS) over time whilst FIG. 6B shows the concentration (vp/ml) of the formulations measured over time. Based on the graphs, an approximate order of increasing stability of the formulations appears to be HEPEs, TRIS, Gly-NaCl and meglumine (best).

Example 7

An experiment was conducted to confirm that the conditions identified using the screening methods in accelerated conditions translated to 4° C. long term storage, with a wider panel of stability indicating methods. A range of different buffers were tested all at 10 mM: Meglumine pH 8.0, Meglumine pH 8.5, Meglumine pH 9.0, TRIS pH 8.5 and Gly-NaCl. All the formulations contained 20% glycerol, 1.4% ethanol, 15 mM arginine, 0.25 mM methionine. The group B adenovirus formulations were stored at both 4° C. and −80° C. for a period of 12 months. The stability and potency of the formulations stored at 4° C. were assessed by AEX-HPLC (virus concentration), MTS (a cell viability assay, which assess the ability of adenovirus to lyse cells) and infectivity assay (assess the ability of adenovirus to infect cells and commence replication) at regular intervals. After 12 months the samples stored at −80° C. and 4° C. were analysed together using the same methods.

Figure 8A:
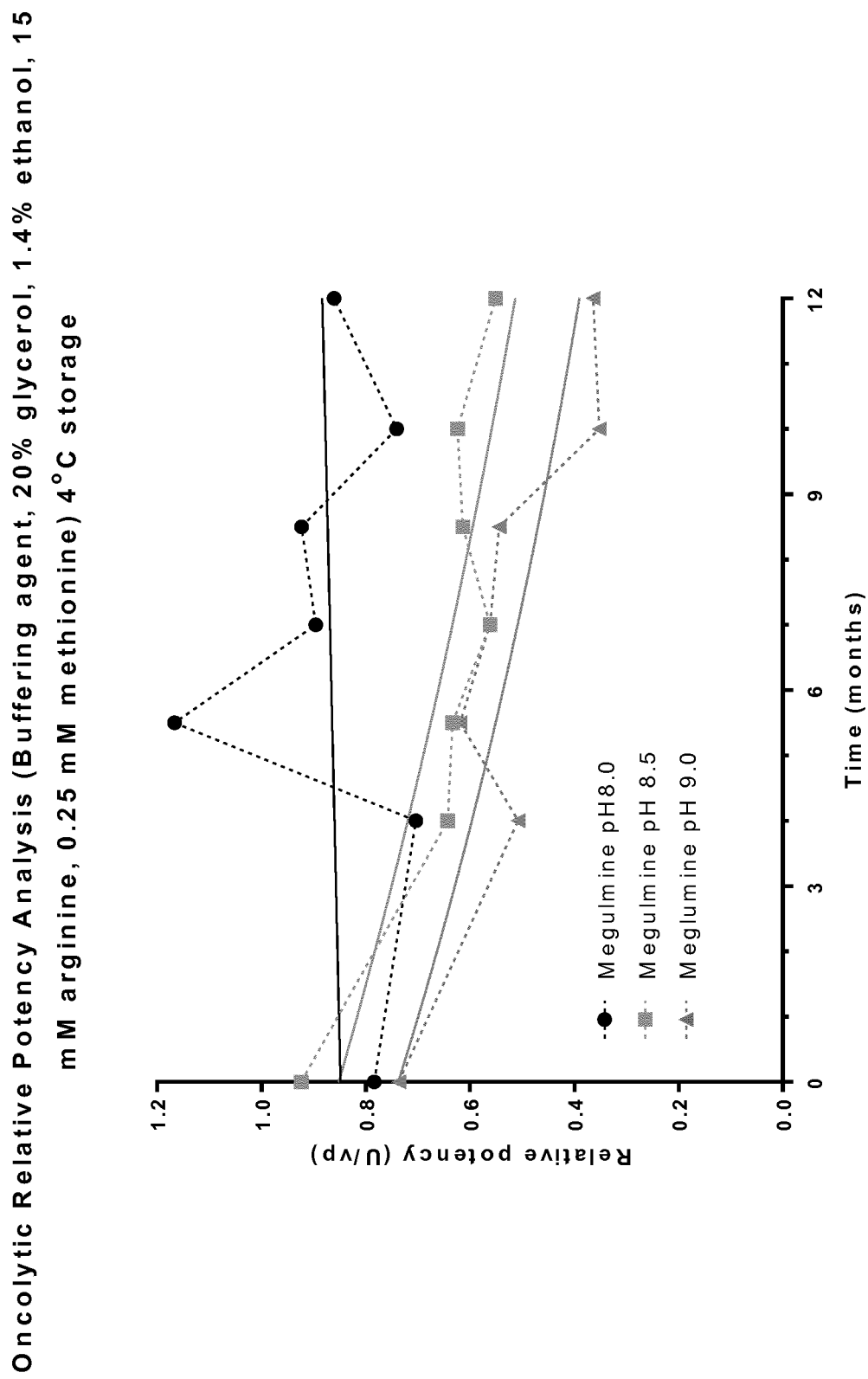
FIG. 8A shows oncolytic relative potency analysis (20% glycerol, 1.4% ethanol, 15 mM arginine, 0.25 mM methionine) stored at 4° C.
Figure 8B:
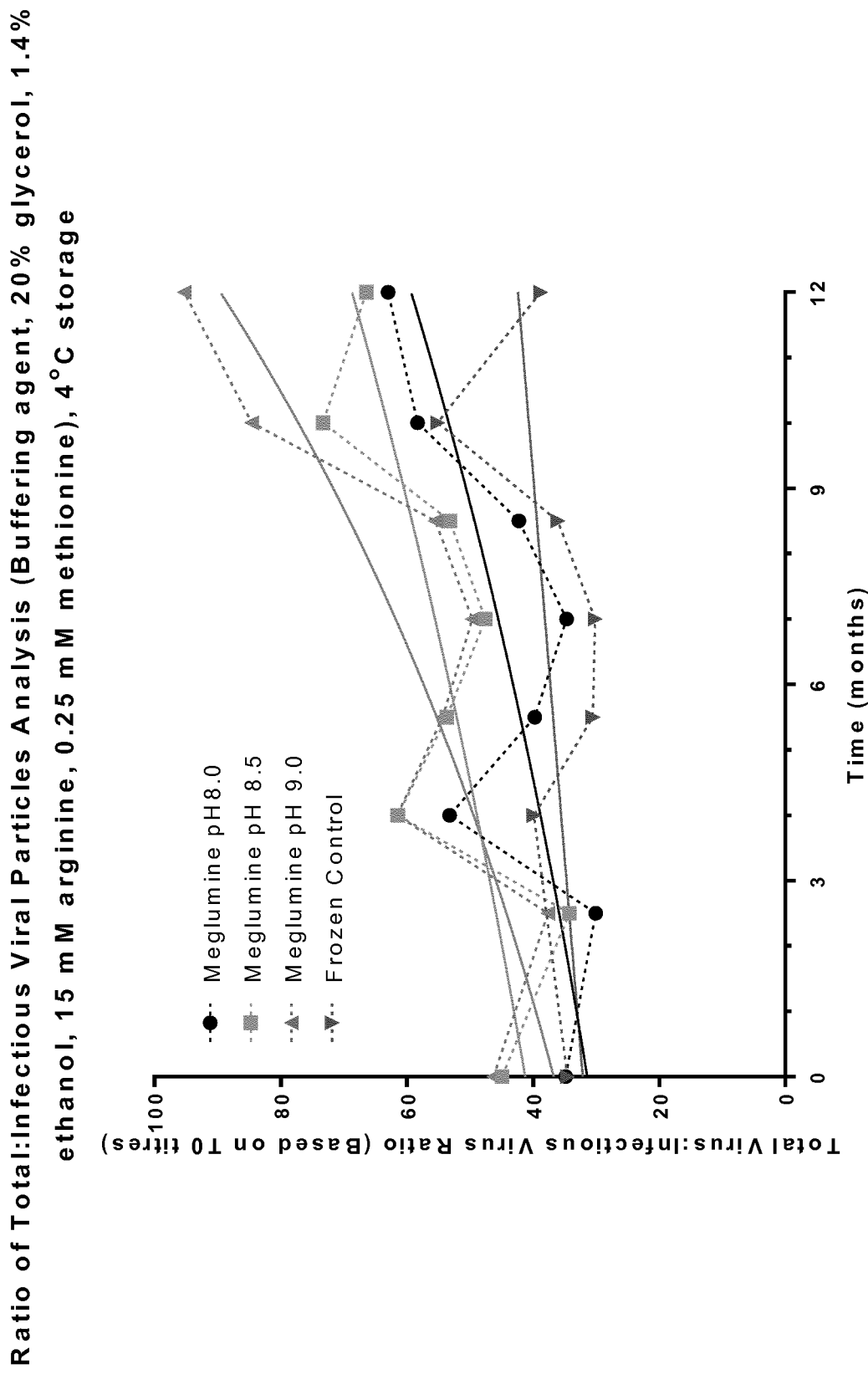
FIG. 8B shows the ratio of total virus: infectious virus particles (20% glycerol, 1.4% ethanol, 15 mM arginine, 0.25 mM methionine) stored at 4° C.

Results of the periodic analysis of the adenovirus stored at 4° C. is shown in FIGS. 8A and 8B. The MTS (relative oncolytic potency) in FIG. 8A shows that adenovirus stored in pH 8.0 is more stable for longer than when stored in pH 8.5 and pH 9.0 buffers. This is confirmed by alternative analysis as shown in FIG. 8B; the ratio of non-infectious particles present upon storage at 4° C. increases earlier as the pH rises. At pH 8.0, with the presence of the excipients (glycerol, methionine, arginine and ethanol), the adenovirus is most stable during storage.

Figure 8E:
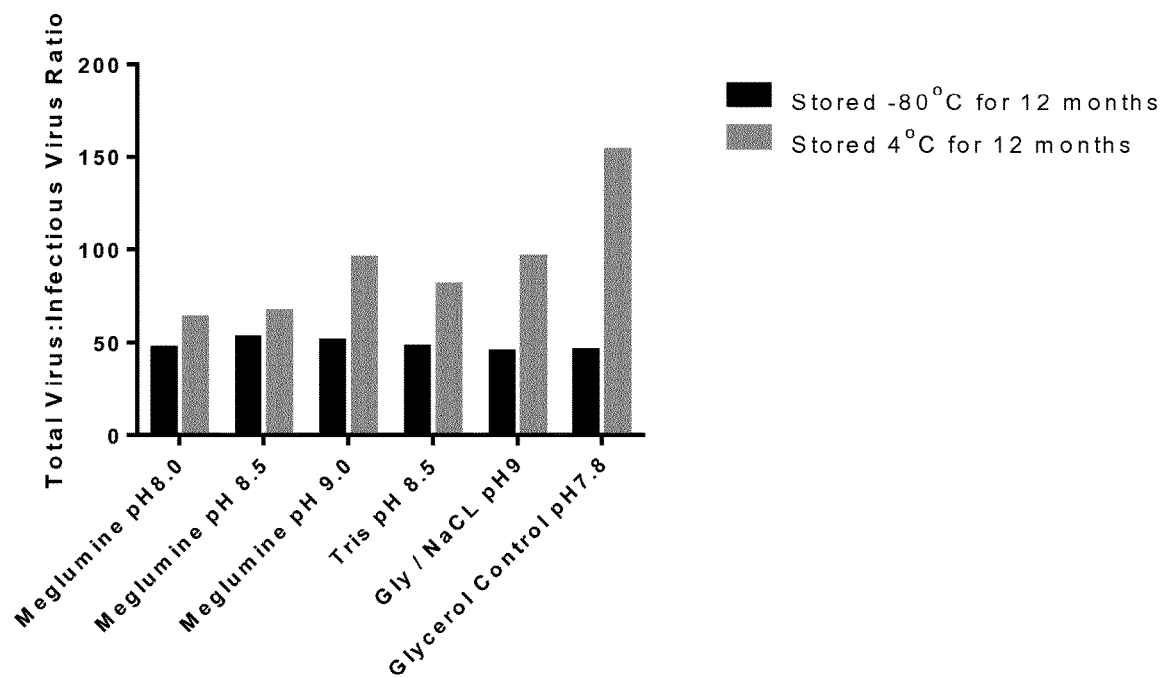
FIG. 8E shows ratio of total virus: infectious virus particle (20% glycerol, 1.4% ethanol, 15 mM arginine, 0.25 mM methionine)

FIGS. 8C, 8D and 8E compare adenovirus that has been stored at 4° C. with adenovirus stored at −80° C. for the same time period. In all Figures the glycerol control is buffered at pH 7.8 and contains 20% glycerol and no other excipients. FIG. 8D confirms that there is no change in the concentration of adenovirus as detected by AEX-HPLC in any of the tested formulations at either temperature. FIG. 8C compares the relative oncolytic potency (MTS) of adenovirus stored in both temperature conditions. The presence of one or more of the excipients (ethanol, arginine or methionine) stabilised the potency of the adenovirus when stored at 4° C. compared to −80° C. With all excipients present, the adenovirus stability as measured by potency, at 4° C. was greatest at pH 8.0, with stability decreasing as pH increased. The results in FIG. 8E, which compare the rate of formation of non-infectious particles on storage, confirms the oncolytic potency (MTS) result.

Storing the virus at 4° C. for 12 months confirmed that the presence of one or more of the excipients (methionine, arginine, ethanol and glycerol) improved the stability of the adenovirus. The results also confirmed that maintenance of pH was essential for adenoviral stability when stored at 4° C. In this experiment the optimal pH for stability was 8.0 and stability decreased with an increase in pH. In example 1, the data indicated that pH >8.0 would be more stable, with an optimum at 8.5-9.0. However, the only buffer condition tested at pH 8.0 was HEPES. It can therefore be concluded that Meglumine, a sugar-based buffering agent has greater stabilising effect on the adenovirus at pH 8.0 compared to the HEPES buffer used in example 1.

SEQUENCE LISTING (65 sequences)

SEQ ID NO: 1 - DNA, 16 bp, Artificial Sequence
  Splice Acceptor (SA)
cctttctctcttcagg

SEQ ID NO: 2 - DNA, 23 bp, Artificial Sequence
  Branched Splice Acceptor (BSA)
tgctaatcctttctctcttcagg

SEQ ID NO: 3 - DNA, 551 bp, Artificial Sequence
  Internal Ribosome Entry sequence (IRES)
cgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataata

SEQ ID NO: 4 - DNA, 192 bp, Artificial Sequence
  Polyadenylation sequence
cagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggtttttt

SEQ ID NO: 5 - DNA, 201 bp, Artificial Sequence
  BX DNA sequence corresponding to and including bp 28166-28366 of the EnAd genome
aaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccag

SEQ ID NO: 6 - DNA, 35 bp, Artificial Sequence
  BY DNA sequence corresponding to and including bp 29345-29379 of the EnAd genome
caaataaagtttaacttgtttatttgaaaatcaat

SEQ ID NO: 7 - protein, 19 aa, Artificial Sequence
  Leader Sequence
MGWSCIILFLVATATGVHS

SEQ ID NO: 8 - protein, 19 aa, Artificial Sequence
  Leader Sequence
MDWTWRVFCLLAVAPGAHS

SEQ ID NO: 9 - protein, 22 aa, Artificial Sequence
  P2A peptide
GSGATNFSLLKQAGDVEENPGP

SEQ ID NO: 10 - protein, 21 aa, Artificial Sequence
  F2A peptide
GSGEGRGSLLTCGDVEENPGP

SEQ ID NO: 11 - protein, 23 aa, Artificial Sequence
  E2A peptide
GSGQCTNYALLKLAGDVESNPGP

SEQ ID NO: 12 - protein, 25 aa, Artificial Sequence
  T2A peptide
GSGVKQTLNFDLLKLAGDVESNPGP

SEQ ID NO: 13 - DNA, 32326 bp, Artificial Sequence
  EnAd genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 14 - DNA, 34099 bp, Artificial Sequence
  NG-73 virus Genome Sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 15 - DNA, 33442 bp, Artificial Sequence
  NG-74 virus Genome Sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 16 - DNA, 34117 bp, Artificial Sequence
  NG-76 virus Genome Sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgacatcatcaccaccaccattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 17 - DNA, 35373 bp, Artificial Sequence
  NG-77 virus Genome Sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatgggatggagctgtatcatcctcttcttggtagcaacagctacaggtgtccactccgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 18 - DNA, 33460 bp, Artificial Sequence
  NG-78 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgacatcatcaccaccaccattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 19 - DNA, 33132 bp, Artificial Sequence
  NG-92 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 20 - DNA, 33765 bp, Artificial Sequence
  NG-95 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgcccaccatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 21 - DNA, 33199 bp, Artificial Sequence
  NG-96 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaacctttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 22 - DNA, 33868 bp, Artificial Sequence
  NG-97 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 23 - DNA, 36030 bp, Artificial Sequence
  NG-134 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatggactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 24 - DNA, 35353 bp, Artificial Sequence
  NG-135 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatgggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtggcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatggactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 25 - DNA, 33314 bp, Artificial Sequence
  NG-139 virus genome sequence consisting of a transgene cassette that encodes the cytokine, TNFa, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccgccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 26 - DNA, 34493 bp, Artificial Sequence
  A virus genome sequence consisting of a transgene cassette that encodes an anti-VEGF full length antibody inserted in the region BY. The transgene cassette contains a SSA, ab heavy chain sequence with 5' leader, a SSA,and ab light chain sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgagcaggcgagcatggactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaacctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 27 - DNA, 34754 bp, Artificial Sequence
  A virus genome sequence consisting of a transgene cassette that encodes an anti-VEGF full length antibody inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgagcaggccgacatggactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 28 - DNA, 34807 bp, Artificial Sequence
  NG-165 virus genome sequence consisting of a transgene cassette encoding an anti-VEGF full length antibody inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaggaagcggagctactaacttcagcctgctgaagcaggctggagacgtggaggagaaccctggacctgactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 29 - DNA, 33432 bp, Artificial Sequence
  NG-167 virus genome sequence consisting of a transgene cassette that encodes an anti-VEGF ScFv with a C-terminal His6 tag, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgggatggagctgtatcatcctcttcttggtagcaacagctacaggtgtccactccgaagtgcaactggtggagtctggcggaggtctggtgcagcctggaggctctctcagactgtcatgcgctgcaagcggttttaccatctctgactactggatccattgggtgcgtcaggctcctggaaaaggccttgagtgggttgcgggtataactccagcaggcgggtacacctactacgccgatagcgttaaaggccgctttaccattagcgcggacaccagcaagaataccgcctatctgcagatgaactcactgagagcggaggatacagcagtgtactattgcgcaagattcgtgttctttctgccatacgctatggactattggggccaagggacactggttacagtatcctcgggtggcggtggctcgggcggtggtggatctggtggcggcggatctgacatccagatgacccagagcccatcaagtctgtccgccagcgttggcgatcgagtcaccattacttgtagggcttctcaggacgtgtctacagctgttgcttggtatcagcagaaaccagggaaagcacccaaacttctgatctactcagcttccttcctgtactcaggagttcctagtcggtttagtggcagcggcagtggcacagacttcacgctcaccattagcagtctccagcctgaggattttgccacttactactgtcagcaagggtatggaaatcccttcacattcgggcaaggaaccaaagtcgagattaagaggcatcatcaccaccaccattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 30 - DNA, 35334 bp, Artificial Sequence
  NG-177 virus genome sequence consisting of a transgene cassette encoding an anti-PD-L1 full length antibody inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaacctttaaaggttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcattatcctgtttctggttgctactgccactggagtgcatagcgaggtacagcttgtcgagtctggaggtgggctggtacaaccaggcggatccctcagactgtcttgtgccgcatctggcttcacgttcagcgatagttggatacactgggtgaggcaggcaccagggaaaggtctggagtgggtggcttggataagcccatatggtggctccacatattacgccgactcagtgaagggtcgcttcaccatttctgctgatacgtcaaagaacacagcctatctccagatgaactcccttcgtgccgaggataccgctgtctactattgtgcccggagacattggcctggcgggttcgactactggggacaggggactctcgtcactgtttctgcagcgtctactaaagggcccagcgtgtttcctcttgctccctccagtaagtcaactagtggcggcaccgctgctttgggctgcctggtcaaggactattttccagagcctgtaaccgtgagctggaatagtggagcattgacctcaggagtgcacacatttcccgcagtgctgcagtcaagcggactgtacagcctttccagtgtggtgaccgttccttcctcaagtctgggcactcaaacctacatctgcaacgtgaaccacaaacccagcaataccaaagtcgacaagaaggttgagccgaagagctgtgacaaaacgcacacatgccctccatgtcccgccccagaactgctcggtggaccgtccgtgttcctgtttcctccgaagcccaaggacacactgatgatcagtcgcaccccagaagtcacctgtgtggtggtggcggtaagccacgaagatcccgaggtcaagttcaattggtatgtcgatggggttgaggtccacaatgccaagactaagccaagggaggaacagtatgccagcacataccgagtcgtgtctgtgctgaccgttctgcatcaggactggctcaacgggaaagagtacaagtgcaaagtgtccaacaaggcacttcctgcccctatcgagaaaaccatcagcaaggcgaaaggtcagcccagagaaccacaagtctacacactgccaccctctcgggacgaactcacaaagaatcaggtgtcactgacatgcttggttaaaggcttttaccccagcgatattgccgtggaatgggaatccaatgggcaacctgagaacaactacaagactacacctcccgtattggatagcgatggaagcttcttcctgtactctaagttgacggttgacaaatccaggtggcagcagggcaatgtgttttcttgctccgtaatgcatgaagctctgcataatcactatacccagaaatccctctcactgagtccgggcaaatgactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatggactggacctggcgcgtgttttgcctgctcgccgtggctcctggggcccacagcgatatccaaatgactcagtctccctcttcactgtctgcaagcgttggcgatagggtgacaattacctgtagagcgagtcaggacgtttcaaccgctgtagcctggtaccagcagaaaccgggaaaagcccctaagctgctcatttactccgcttcctttctctattccggagtgcctagccgatttagtggctctggttcagggactgacttcacactgaccatatccagtctgcaaccagaggatttcgcgacgtactactgtcagcagtatctgtatcaccccgctacatttgggcaagggacaaaagtggagatcaaacggactgtagccgcacccagcgtgttcatctttccaccctctgatgagcagcttaagagcggtacggcatctgtcgtgtgcttgctgaacaacttctatcctcgtgaagccaaagtccagtggaaggtggacaatgccttgcagtcaggcaactcacaggaaagcgtcactgaacaggacagcaaggatagtacctacagcctgtccagcacactgactctctccaaagccgactatgagaagcacaaggtttacgcttgcgaagtgacccatcaaggccttagcagtccagtcaccaagtccttcaatcgcggagagtgctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 31 - DNA, 32364 bp, Artificial Sequence
  NG-185 virus genome sequence consisting of the EnAd genome with unique restriction sites inserted into the BX and BY regions
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttactgcggccgctatggccggcctgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctaccctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 32 - DNA, 34792 bp, Artificial Sequence
  NG-190 virus genome sequence consisting of a transgene cassette encoding an anti-PD-L1 full length antibody inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcattatcctgtttctggttgctactgccactggagtgcatagcgaggtacagcttgtcgagtctggaggtgggctggtacaaccaggcggatccctcagactgtcttgtgccgcatctggcttcacgttcagcgatagttggatacactgggtgaggcaggcaccagggaaaggtctggagtgggtggcttggataagcccatatggtggctccacatattacgccgactcagtgaagggtcgcttcaccatttctgctgatacgtcaaagaacacagcctatctccagatgaactcccttcgtgccgaggataccgctgtctactattgtgcccggagacattggcctggcgggttcgactactggggacaggggactctcgtcactgtttctgcagcgtctactaaagggcccagcgtgtttcctcttgctccctccagtaagtcaactagtggcggcaccgctgctttgggctgcctggtcaaggactattttccagagcctgtaaccgtgagctggaatagtggagcattgacctcaggagtgcacacatttcccgcagtgctgcagtcaagcggactgtacagcctttccagtgtggtgaccgttccttcctcaagtctgggcactcaaacctacatctgcaacgtgaaccacaaacccagcaataccaaagtcgacaagaaggttgagccgaagagctgtgacaaaacgcacacatgccctccatgtcccgccccagaactgctcggtggaccgtccgtgttcctgtttcctccgaagcccaaggacacactgatgatcagtcgcaccccagaagtcacctgtgtggtggtggcggtaagccacgaagatcccgaggtcaagttcaattggtatgtcgatggggttgaggtccacaatgccaagactaagccaagggaggaacagtatgccagcacataccgagtcgtgtctgtgctgaccgttctgcatcaggactggctcaacgggaaagagtacaagtgcaaagtgtccaacaaggcacttcctgcccctatcgagaaaaccatcagcaaggcgaaaggtcagcccagagaaccacaagtctacacactgccaccctctcgggacgaactcacaaagaatcaggtgtcactgacatgcttggttaaaggcttttaccccagcgatattgccgtggaatgggaatccaatgggcaacctgagaacaactacaagactacacctcccgtattggatagcgatggaagcttcttcctgtactctaagttgacggttgacaaatccaggtggcagcagggcaatgtgttttcttgctccgtaatgcatgaagctctgcataatcactatacccagaaatccctctcactgagtccgggcaaaggaagcggagctactaacttcagcctgctgaagcaggctggagacgtggaggagaaccctggacctgactggacctggcgcgtgttttgcctgctcgccgtggctcctggggcccacagcgatatccaaatgactcagtctccctcttcactgtctgcaagcgttggcgatagggtgacaattacctgtagagcgagtcaggacgtttcaaccgctgtagcctggtaccagcagaaaccgggaaaagcccctaagctgctcatttactccgcttcctttctctattccggagtgcctagccgatttagtggctctggttcagggactgacttcacactgaccatatccagtctgcaaccagaggatttcgcgacgtactactgtcagcagtatctgtatcaccccgctacatttgggcaagggacaaaagtggagatcaaacggactgtagccgcacccagcgtgttcatctttccaccctctgatgagcagcttaagagcggtacggcatctgtcgtgtgcttgctgaacaacttctatcctcgtgaagccaaagtccagtggaaggtggacaatgccttgcagtcaggcaactcacaggaaagcgtcactgaacaggacagcaaggatagtacctacagcctgtccagcacactgactctctccaaagccgactatgagaagcacaaggtttacgcttgcgaagtgacccatcaaggccttagcagtccagtcaccaagtccttcaatcgcggagagtgctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 33 - DNA, 33843 bp, Artificial Sequence
  NG-217 virus genome sequence consisting of a transgene cassette that encodes the tumour associated antigen, NY-ESO-1, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtaccaccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 34 - DNA, 33770 bp, Artificial Sequence
  NG-220 virus genome sequence consisting of a transgene cassette that encodes the tumour associated antigen, NY-ESO-1, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctacccctcccctagtcaggaagttcccccccgccccgcagctcgcgtcatgcaggacgtgacaaatggaagtagcacgtctcactagtctcgtgcaaatggacagcaccgctgagcaatggaagcgggtaggcccttggggcagcggccaatagcagctttgctccttcgctttctgggctcagaggctgggaaggggtgggtccgggggcgggctcaggggcgggctcaggggcggggcgggcgcccgaaggtcctccggaggcccggcattccgcacgcttcaaaagcgcacgtctgccgcgctgttctcttcttcctcatctccgggcctttcgagatctttgtcgatcctaccatccactcgacacacccgccagcggccgctgccaagcttccgagctctcgaattcaaaggaggtaccaccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 35 - DNA, 34792 bp, Artificial Sequence; identical to SEQ ID NO: 32
  NG-221 virus genome sequence consisting of the EnAd genome with a transgene cassette that encodes an anti-PD-L1 ScFv with a C-terminal His6 tag, inserted in the region BY

SEQ ID NO: 36 - DNA, 35361 bp, Artificial Sequence
  NG-242 virus genome sequence consisting of a transgene cassette encoding an anti-CTLA-4 full length antibody inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatccgaggggagctaccctttactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatggactggacctggcgcgtgttttgcctgctcgccgtggctcctggggcccacagcgatatccagatgacccagtctccatcctccctgtctgcatctgtaggagacagagtcaccatcacttgccgggcaagtcagagcattaacagctatttagattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagtattacagtactccattcactttcggccctgggaccaaagtggaaatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 37 - DNA, 33464 bp, Artificial Sequence
  NG-257 virus genome sequence comprising the EnAd genome with a transgene cassette encoding an anti-VEGF ScFv inserted into the region Bx
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttactgcggccgctgctaatcctttctctcttcaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgacatcatcaccaccaccattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtgggccggcctgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctaccctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 38 - DNA, 35501 bp, Artificial Sequence
  NG258 virus genome sequence consisting of a transgene cassette encoding an anti-VEGF full length antibody inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttactgcggccgctatggccggcctgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaggaagcggagctactaacttcagcctgctgaagcaggctggagacgtggaggagaaccctggacctgactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 39 - DNA, 34327 bp, Artificial Sequence
  NG-272 virus genome sequence comprising the EnAd genome with a transgene cassette encoding an anti-VEGF ScFv and an anti-PD-L1 ScFv inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcatcatactgttcctggttgccacagctacaggggtacactccgaagtccagctcgttgaaagcggaggcgggttggtccaacctggcggctcacttcggctttcctgtgcagctagtgggttcaccttttccgatagctggatacactgggtgagacaggctccaggcaaaggcttggaatgggtcgcctggattagcccctatggaggcagcacctattacgccgattctgtgaaggggaggttcacaatctccgccgataccagtaagaacacagcctatctgcagatgaatagtctccgagccgaggacactgcagtgtactactgcgctaggcgtcattggccaggaggctttgactactggggtcaaggtaccctcgtgactgtgagtgcaggtggcggtggctcgggcggtggtggatctggtggcggcggatctgacatccagatgacacagagccctagctcactgtctgcgagcgtaggcgacagagtgaccatcacttgtcgggcttcccaggatgtgtccacagccgttgcatggtaccagcagaaacccgggaaagcaccaaagctgctgatctacagcgcttctttcctgtactcaggcgtgcctagccgctttagtgggtctggttctgggactgacttcaccctcacgatttcctcactgcaacccgaggattttgcgacctattactgccagcagtatctgtatcatccggccacttttgggcaaggcacgaaggtcgagattaagcgccatcatcaccaccaccacggaagcggagctactaacttcagcctgctgaagcaggctggagacgtggaggagaaccctggacctggttggtcgtgtataatcctatttctcgtagcaactgcgactggcgtccatagtgaggttcagctggtggagtctggcggtggcctggtgcagccagggggttcactccgtttgtcttgtgcggcttctggctataccttcaccaactatggtatgaactgggtccgtcaggccccgggtaagggcctggagtgggttggatggattaacacctataccggtgaaccgacctatgctgcggatttcaaacgtcgttttactttttctctggacacctccaagagcacagcttacctccagatgaacagcctgcgcgctgaggacactgccgtctattactgtgcaaagtacccgcactattatgggagcagccactggtatttcgacgtctggggacaaggaaccctggtcaccgtctcctcgggaggtggtggaagtgggggcggcggtagcggagggggtggtagcgatatacaaatgacccagtccccgtctagcctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggaagtgggacggatttcactctgaccatcagcagtctgcagccagaagacttcgcaacttattactgtcaacagtatagcaccgtgccgtggacgtttggacagggtaccaaagtggaaataaaacgaggtaagcctatccctaaccctctcctcggtctcgattctacgtaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 40 - DNA, 34558 bp, Artificial Sequence
  NG-280 virus genome sequence consisting of a transgene cassette encoding the sodium iodide symporter (NIS) inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 41 - DNA, 33464 bp, Artificial Sequence; identical to SEQ ID NO: 37
  NG-281 virus genome sequence comprising the EnAd genome with a transgene cassette encoding an anti-VEGF ScFv inserted into the region Bx and a second transgene cassette encoding an anti-PD-L1 ScFv inserted into the region BY

SEQ ID NO: 42 - DNA, 33493 bp, Artificial Sequence
  NG-330 virus genome sequence comprising the EnAd genome with a transgene cassette that encodes the T lymphocyte activation antigen, CD80, inserted in the region BY. The transgene cassette contains a 5' SSA, human CD80 cDNA sequence and a 3' poly(A)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 43 - DNA, 34119 bp, Artificial Sequence
  NG-343 virus genome sequence comprising the EnAd genome with a transgene cassette that encodes IFNa, and CD80, inserted in the region BY. The transgene cassette contains a 5' SSA, IFNa cDNA sequence, P2A peptide, CD80 cDNA sequence and a 3' poly(A)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaaggaagcggagctactaacttcagcctgctgaagcaggctggagacgtggaggagaaccctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 44 - DNA, 35602 bp, Artificial Sequence
  NG-641  Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacaggaagcggacagtgtactaattatgctctcttgaaattggctggagatgttgagagcaaccctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 45 - DNA, 34131 bp, Artificial Sequence
  NG-345 virus genome sequence comprising the EnAd genome with a transgene cassette that encodes Flt3 Ligand, MIP1a and IFNa, inserted in the region BY. The transgene cassette contains a 5' SSA, Flt3 Ligand cDNA sequence,P2A peptide sequence, MIP1a cDNA
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 46 - DNA, 34432 bp, Artificial Sequence
  NG-346 virus genome sequence comprising the EnAd genome with a transgene cassette that encodes Flt3 Ligand, MIP1a and CD80, inserted in the region BY. The transgene cassette contains a 5' SSA, Flt3 Ligand cDNA sequence,P2A peptide sequence, MIP1a cDNA
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagatagga

SEQ ID NO: 47 - DNA, 34458 bp, Artificial Sequence
  NG-347 virus genome sequence comprising the EnAd genome with a transgene cassette that encodes IFNa, MIP1a and CD80, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaaggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 48 - DNA, 34522 bp, Artificial Sequence
  NG-348 virus genome sequence comprising the EnAd genome with a transgene cassette that encodes a membrane-anchored chimeric form of the single chain Fv anti-human CD3e and the T lymphocyte activation antigen, CD80 inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgtggaagcggagctactaacttcagcctgctgaagcaggctggagacgtggaggagaaccctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 49 - DNA, 34555 bp, Artificial Sequence
  NG-348A virus genome sequence comprising the EnAd genome with a transgene cassette that encodes a membrane-anchored chimeric form of the single chain Fv anti-human CD3e with C-terminal V5 tag and the T lymphocyte activation antigen
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgtggttcaatccctaaccctctcctcggtctcgatggaagcggagctactaacttcagcctgctgaagcaggctggagacgtggaggagaaccctggacctggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 50 - DNA, 34794 bp, Artificial Sequence
  NG-350A genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatggactggacctggcgcatcctgttcttggtggcagctgctacgggagctcattcccaggtgcagctggtgcaatccggcgctgaggtgaagaaacccggggcttcagtcaaagtcagctgcaaggctagcggctacacctttactggctattacatgcactgggtgaggcaggctccgggacagggtctggaatggatgggatggatcaatccggacagcggcgggaccaattacgcacaaaagttccaaggccgcgtgacgatgacccgggacacttcgatctcaaccgcctacatggagctgaaccgcctgaggtcggatgacaccgctgtgtactactgcgctcgcgaccaacccctggggtactgcaccaacggagtgtgttcatacttcgactactggggccaaggcacgctggtcactgtgtcatcggcgtccactaagggcccgtcggtcttcccactagctccgtgctcgcggtcgacttcggaatcaactgcggcactcggatgccttgtcaaggactacttcccagaacccgtgaccgtctcgtggaactcaggcgccctgacgagcggtgtccacactttcccggcggtgctgcagtcatcggggctatacagcctgagcagcgtggttactgtgccgtcatcaaacttcgggacccagacttacacttgcaatgtggaccacaagccgtcaaataccaaagtggacaagactgtggaacgcaaatgttgcgtggaatgccctccgtgcccggcccccccagtcgctggcccatccgtgttcctcttccctccgaagccaaaagacactctgatgatttcgagaactccggaggtcacttgcgtggtggtcgacgtgtcgcacgaggatccagaggtgcagttcaactggtacgtggatggagtggaggtgcacaatgccaagaccaagccgcgcgaagaacaattcaactccacctttcgggtcgtgtccgtgctgaccgtggtacaccaagactggctgaacggaaaggagtacaaatgcaaggtgagcaacaaggggctgccggctccaatcgaaaagaccatctcaaagactaaggggcaacctcgcgagccacaggtgtataccctgcctccaagcagggaggaaatgaccaaaaaccaggtgagcctgacctgtctggtgaagggcttttaccccagcgacatcgccgtcgagtgggaaagcaacggacaacccgagaacaactacaagaccactccgcccatgctggactccgacgggtcatttttcctgtactcaaagctgactgtggacaagtcccggtggcagcaaggtaacgtgttctcctgctcggtgatgcacgaagctttgcacaaccactacactcaaaagtcactttccttgtcaccgggcaaggggtcgggcgccactaacttttccttgctcaagcaggcgggcgatgtggaggagaatccgggcccgcgcctcccggcgcaactgctgggcctcctcctcctctggtttcccggctcccgctgtgacatccagatgactcagtcgcccagctccgtgtccgcatcggtgggggacagagtcaccatcacctgcagagcttcacaagggatctattcctggctggcgtggtatcagcagaagcctggaaaggcccccaacctcctgatttacaccgcatcgactctccagtcaggcgtgccatcccggttctcagggtccggctccggaaccgacttcactctgactatcagctccctgcaaccagaagatttcgctacctactactgccagcaggcaaacatctttccgctaactttcggcggaggcacgaaggtggagatcaagagaaccgtggcggccccttccgtcttcatcttcccaccgtcagacgaacaactcaaatccggtaccgcctccgtcgtgtgcctgctcaataacttctatccacgcgaggccaaggtccagtggaaagtggataacgccctgcagtccggaaacagccaggagtcagtgaccgaacaggattccaaggacagcacttactcgctctcaagcaccctcaccctgtcgaaggcggattacgagaagcacaaagtctacgcctgcgaagtgactcatcaaggactctcatcaccggtaactaagagcttcaatcgcggagaatgctaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 51 - DNA, 33595 bp, Artificial Sequence
  NG-420 virus genome sequence comprising the EnAd genome with a transgene cassette that encodes a membrane-anchored chimeric form of the single chain Fv anti-human CD3e inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 52 - DNA, 33628 bp, Artificial Sequence
  NG-420A virus genome sequence comprising the EnAd genome with a transgene cassette that encodes a membrane-anchored chimeric form of the single chain Fv anti-human CD3e and a C-terminal V5 tag, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggatccgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgtggttcaatccctaaccctctcctcggtctcgattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 53 - DNA, 34883 bp, Artificial Sequence
  NG-601 (EnAd-CMV-EpCAMBiTE)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagcgatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 54 - DNA, 34204 bp, Artificial Sequence
  NG-602 (EnAd-SA-EpCAMBiTE)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagcgatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 55 - DNA, 34895 bp, Artificial Sequence
  NG-605 (EnAd-CMV-FAPBiTE)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 56 - DNA, 34216 bp, Artificial Sequence
  NG-606 (EnAd-SA-FAPBiTE)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 57 - DNA, 34198 bp, Artificial Sequence
  NG-611 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 58 - DNA, 34210 bp, Artificial Sequence
  NG-612 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 59 - DNA, 34220 bp, Artificial Sequence
  NG-613 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 60 - DNA, 34226 bp, Artificial Sequence
  NG-614 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 61 - DNA, 35749 bp, Artificial Sequence
  NG-615 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggacagtgtactaattatgctctcttgaaattggctggagatgttgagagcaaccctggacctacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 62 - DNA, 35759 bp, Artificial Sequence
  NG-616 genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggacagtgtactaattatgctctcttgaaattggctggagatgttgagagcaaccctggacctacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 63 - DNA, 34180 bp, Artificial Sequence
  NG-617 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 64 - DNA, 35788 bp, Artificial Sequence
  NG-618 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggttggagctgtattattctcttcctcgtcgccaccgcgaccggagtgcattccgagctcgtgatgacccagtcaccatcatccttgaccgtgactgcgggcgagaaggtcacgatgtcatgcaagtcgtcacaaagcctgctgaactccggcaatcagaagaattacctgacctggtaccagcagaaaccgggtcagccgccaaaactgctgatctactgggcatccacccgggaaagcggggtccctgaccggttcactggatcaggatcaggaaccgactttaccctcacgatctcaagcgtccaagccgaggacttggctgtgtactactgccaaaatgactactcgtaccccctgactttcggagctgggaccaagctggagatcaaaggcggcggagggtccggaggaggggggtcgggaggggggggaagcgaggtgcagctgctggaacagagcggagccgagctggtgagaccaggcaccagcgtgaaaatctcgtgcaaggcctcggggtacgctttcacgaactactggttgggttgggtgaagcagcggccgggtcatggactggagtggatcggagacatctttcccggaagcggaaatatccattacaacgaaaagtttaaaggcaaggccacccttactgcggataagtcaagctccaccgcttacatgcaactgtcctcactgacttttgaagacagcgctgtgtatttctgcgctcgcctgcgcaattgggatgaacctatggactactggggccaaggaaccaccgtgactgtgtcgtcgggagggggaggctcacaagtgcagctgcagcagtcaggtgcagaattggccaggccgggagccagcgtgaagatgtcgtgcaaagcctccggctacaccttcactcgctacactatgcattgggtgaaacagcggccgggacaagggctggagtggatcggatacatcaatccatcaagaggttacaccaactacaatcagaagttcaaggacaaggctaccctgacgactgataagagctcgtcaactgcatacatgcagctgtcgagcctgaccagcgaggattccgccgtgtactactgcgcgagatactatgatgaccactactgcttggattactggggccaagggaccactctgaccgtgtcctccggcggagggggctcgggcggcgggggctcggggggcggcggcagcgacatcgtgctgacgcagagccccgcaatcatgtcagcctcccctggcgaaaaagtgacgatgacctgctccgcttcctcatcagtctcctacatgaactggtatcaacagaagagcggaacctcgccgaagcgctggatctacgatacctccaaactggccagcggagtgccggcgcattttcggggatcgggcagcggtacctcctactcgctcaccatctcaggaatggaagccgaagacgccgccacctactactgccagcagtggtcctcaaacccattcaccttcggatccggcactaagctggaaatcaaccgcgggagcggagcgactaacttcagcttgctcaagcaagccggagatgtcgaggagaacccgggacctggttggtcgtgcatcatcctattccttgtcgcgaccgcaactggcgtccattccgacatcgtcatgacccaatccccagattcgctggcggtgtcgcttggggaacgggcaaccatcaactgcaagagctcgcagtcactgctatacagccggaatcagaaaaactacctggcgtggtaccagcaaaagccgggtcagcctccgaagctgctgattttctgggcctcaacccgggaatccggagtccctgacagattcagcgggtccggattcgggaccgacttcactctgactatttcgagcctgcaagcagaagatgtggcagtgtactattgccaacagtatttttcatacccgctgaccttcggccagggtacgaaggtggagatcaagggtggagggggtagcggcgggggaggcagcggcggggggggaagccaggtgcagctggtccaatcaggcgccgaggtcaagaaacctggagcgtcggtcaaggtctcctgcaagactagccgctacacttttaccgaatacaccatccactgggtcagacaggcgcccggtcagcgcctggagtggatcggcgggatcaacccgaataatggaatcccgaactacaatcaaaaattcaaaggccgcgtgactatcaccgtggatacttcagcctcaactgcttacatggaactgtcatcgctgagatcagaggacactgcggtctactactgtgcgcgcagaagaatcgcttacggatacgacgaggggcacgcaatggactactggggacagggaaccctggtgaccgtgtcgtcaggcggaggaggatcggatgtgcagttggtgcagtcgggcgccgaagtgaaaaaaccgggggcctcagtgaaagtgtcctgcaaggcctccggatacaccttcacccgctacactatgcactgggtcaggcaggcgcccgggcagggcctggagtggatcgggtatatcaacccgtcaaggggatacactaactacgccgactccgtgaagggaagattcactatcaccactgacaaatcaacttcgacggcgtatatggaactgtcatccttgagatcggaagataccgcgacctactactgtgcgcgctactacgatgaccattactgcctcgattactggggacagggcaccacggtgaccgtctcatcaggagaaggaacttcaactggttccggaggctccggcggctcaggcggcgctgacgacattgtgctgacccagagcccggcgaccctgtcactctcgccgggggaaagggctactctgtcatgcagagcgtcacaatcggtctcatacatgaactggtaccagcagaaaccgggcaaggctccaaagcggtggatctacgatacttcgaaggtggcttcaggagtgccggctcgcttcagcggatccggctcgggaaccgattacagcttgaccattaactcgctggaggcggaggatgcagcgacctactactgtcaacaatggtcctcgaacccactcacttttgggggcgggaccaaggtggagattaagtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 65 - DNA, 34972 bp, Artificial Sequence
  NG-640 - Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

The invention claimed is:

1. A liquid formulation suitable for a group B adenovirus, comprising:
   a) a group B adenovirus,
   b) 15 to 25% v/v glycerol;
   c) 0.1 to 1.5% v/v ethanol;
   d) 0.01-0.3 mM methionine; and
   e) a buffer,
   wherein:
   the pH of the formulation is in the range 8.0 to 9.6, and
   the formulation does not comprise a sugar.

2. The formulation according to claim 1, wherein the formulation is for administration by intravenous injection.

3. The formulation according to claim 2, wherein the formulation is for administration by slow injection.

4. The formulation according to claim 2, wherein the formulation is for administration by infusion.

5. The formulation according to claim 1, further comprising a surfactant.

6. The formulation according to claim 5, further comprising polysorbate.

7. The formulation according to claim 6, further comprising 0.05-0.15% polysorbate.

8. The formulation according to claim 6, wherein the formulation comprises polysorbate 80.

9. The formulation according to claim 1, further comprising arginine.

10. The formulation according to claim 9, further comprising 5 to 20 mM arginine.

11. The formulation according to claim 1, wherein the buffer is selected from meglumine, glycine, TRIS and combinations thereof.

12. The formulation according to claim 11, wherein the formulation comprises meglumine buffer.

13. The formulation according to claim 1, wherein the formulation does not comprise HEPES buffer.

14. The formulation according to claim 1, wherein the formulation comprises:
   a) 15-20% v/v glycerol;
   b) 1-1.5% v/v ethanol;
   c) 0.1-0.2% v/v polysorbate 80;
   d) 0.2-0.3 mM methionine;
   e) 10-20 mM arginine; and
   f) a buffer;
   wherein the pH of the formulation is at a pH in the range 8.0 to 9.6.

15. A method of treating cancer in a patient in need thereof, comprising administering a therapeutically effective amount of the formulation according to claim 1 to the patient.

16. The method of treating cancer in a patient according to claim 15, wherein the cancer is independently selected from colorectal cancer, hepatoma, prostate cancer, pancreatic cancer, breast cancer, ovarian cancer, thyroid cancer, renal cancer, bladder cancer, head and neck cancer, or lung cancer.

17. The method of treating cancer in a patient according to claim 15, wherein the formulation is administered by intravenous or intratumoral injection.

* * * * *